United States Patent 12,545,960 (METHODS FOR SIMULTANEOUS AMPLIFICATION OF TARGET LOCI) - sequence listing, part 3

SEQ ID NO: 39298 - DNA, 23 bp, synthetic construct
  misc_feature 1..23: note = Synthetic Construct
  source 1..23: mol_type = other DNA
agaaagtggcaaatggctgtaac

SEQ ID NO: 39299 - DNA, 24 bp, synthetic construct
  misc_feature 1..24: note = Synthetic Construct
  source 1..24: mol_type = other DNA
ctcctagtccagtgctttctcagt

SEQ ID NO: 39300 - DNA, 25 bp, synthetic construct
  misc_feature 1..25: note = Synthetic Construct
  source 1..25: mol_type = other DNA
ggccgtaaataaacctccccatttg

SEQ ID NO: 39301 - DNA, 25 bp, synthetic construct
  misc_feature 1..25: note = Synthetic Construct
  source 1..25: mol_type = other DNA
tgcagactcagtatgaagtcagaac

SEQ ID NO: 39302 - DNA, 20 bp, synthetic construct
  misc_feature 1..20: note = Synthetic Construct
  source 1..20: mol_type = other DNA
accctgggacaaacctgtct

SEQ ID NO: 39303 - DNA, 23 bp, synthetic construct
  misc_feature 1..23: note = Synthetic Construct
  source 1..23: mol_type = other DNA
cccttacacagtgtctgctttga

SEQ ID NO: 39304 - DNA, 22 bp, synthetic construct
  misc_feature 1..22: note = Synthetic Construct
  source 1..22: mol_type = other DNA
ccttcacctgtagggctcaaac

SEQ ID NO: 39305 - DNA, 23 bp, synthetic construct
  misc_feature 1..23: note = Synthetic Construct
  source 1..23: mol_type = other DNA
catgggcttttgtggcttgaatc

SEQ ID NO: 39306 - DNA, 20 bp, synthetic construct
  misc_feature 1..20: note = Synthetic Construct
  source 1..20: mol_type = other DNA
agatgtgtctccccgcatgt

SEQ ID NO: 39307 - DNA, 22 bp, synthetic construct
  misc_feature 1..22: note = Synthetic Construct
  source 1..22: mol_type = other DNA
caccaggcttcaaacacactga

SEQ ID NO: 39308 - DNA, 21 bp, synthetic construct
  misc_feature 1..21: note = Synthetic Construct
  source 1..21: mol_type = other DNA
gtggccctaaagtcaccatgt

SEQ ID NO: 39309 - DNA, 23 bp, synthetic construct
  misc_feature 1..23: note = Synthetic Construct
  source 1..23: mol_type = other DNA
gggaatatggcagcacaggctta

SEQ ID NO: 39310 - DNA, 27 bp, synthetic construct
  misc_feature 1..27: note = Synthetic Construct
  source 1..27: mol_type = other DNA
tttagtagtagctcagagtggatgaac

SEQ ID NO: 39311 - DNA, 20 bp, synthetic construct
  misc_feature 1..20: note = Synthetic Construct
  source 1..20: mol_type = other DNA
acaggctctgctccactaga

SEQ ID NO: 39312 - DNA, 20 bp, synthetic construct
  misc_feature 1..20: note = Synthetic Construct
  source 1..20: mol_type = other DNA
gcaaggctgatgcctgatct

SEQ ID NO: 39313 - DNA, 22 bp, synthetic construct
  misc_feature 1..22: note = Synthetic Construct
  source 1..22: mol_type = other DNA
tcacatgggcatgttgtgtgat

SEQ ID NO: 39314 - DNA, 21 bp, synthetic construct
  misc_feature 1..21: note = Synthetic Construct
  source 1..21: mol_type = other DNA
tacccgaggctggggaaagaa

SEQ ID NO: 39315 - DNA, 22 bp, synthetic construct
  misc_feature 1..22: note = Synthetic Construct
  source 1..22: mol_type = other DNA
gggctggtctagatgcttcctt

SEQ ID NO: 39316 - DNA, 26 bp, synthetic construct
  misc_feature 1..26: note = Synthetic Construct
  source 1..26: mol_type = other DNA
gtgacttcctgaggttctatgcctaa

SEQ ID NO: 39317 - DNA, 20 bp, synthetic construct
  misc_feature 1..20: note = Synthetic Construct
  source 1..20: mol_type = other DNA
ggccagcgtagagctaccaa

SEQ ID NO: 39318 - DNA, 23 bp, synthetic construct
  misc_feature 1..23: note = Synthetic Construct
  source 1..23: mol_type = other DNA
tgtctggtatgcaactgtgaact

SEQ ID NO: 39319 - DNA, 21 bp, synthetic construct
  misc_feature 1..21: note = Synthetic Construct
  source 1..21: mol_type = other DNA
tgggctagggaatggggattg

SEQ ID NO: 39320 - DNA, 27 bp, synthetic construct
  misc_feature 1..27: note = Synthetic Construct
  source 1..27: mol_type = other DNA
gcagaaaagagtaaacagccagcacta

SEQ ID NO: 39321 - DNA, 24 bp, synthetic construct
  misc_feature 1..24: note = Synthetic Construct
  source 1..24: mol_type = other DNA
tcagtgtggacatggaaagagaaa

SEQ ID NO: 39322 - DNA, 24 bp, synthetic construct
  misc_feature 1..24: note = Synthetic Construct
  source 1..24: mol_type = other DNA
ggcttcaagaaagggaagcgtact

SEQ ID NO: 39323 - DNA, 20 bp, synthetic construct
  misc_feature 1..20: note = Synthetic Construct
  source 1..20: mol_type = other DNA
ctccagctcctgctttggaa

SEQ ID NO: 39324 - DNA, 22 bp, synthetic construct
  misc_feature 1..22: note = Synthetic Construct
  source 1..22: mol_type = other DNA
cctttcccttgagtccctctct

SEQ ID NO: 39325 - DNA, 22 bp, synthetic construct
  misc_feature 1..22: note = Synthetic Construct
  source 1..22: mol_type = other DNA
caccactggctcgtagtgtgaa

SEQ ID NO: 39326 - DNA, 23 bp, synthetic construct
  misc_feature 1..23: note = Synthetic Construct
  source 1..23: mol_type = other DNA
ctggacttcaggcttggactaga

SEQ ID NO: 39327 - DNA, 20 bp, synthetic construct
  misc_feature 1..20: note = Synthetic Construct
  source 1..20: mol_type = other DNA
tggaacaaggcaggttgctt

SEQ ID NO: 39328 - DNA, 23 bp, synthetic construct
  misc_feature 1..23: note = Synthetic Construct
  source 1..23: mol_type = other DNA
gcaaccggtcgaatatgctctga

SEQ ID NO: 39329 - DNA, 24 bp, synthetic construct
  misc_feature 1..24: note = Synthetic Construct
  source 1..24: mol_type = other DNA
ggacagaagagctgtccccatact

SEQ ID NO: 39330 - DNA, 21 bp, synthetic construct
  misc_feature 1..21: note = Synthetic Construct
  source 1..21: mol_type = other DNA
ggctgtgcttgtcttcagcta

SEQ ID NO: 39331 - DNA, 23 bp, synthetic construct
  misc_feature 1..23: note = Synthetic Construct
  source 1..23: mol_type = other DNA
cacaatgttccgagttgcctttc

SEQ ID NO: 39332 - DNA, 25 bp, synthetic construct
  misc_feature 1..25: note = Synthetic Construct
  source 1..25: mol_type = other DNA
cccaccaccatggactaaagggtta

SEQ ID NO: 39333 - DNA, 30 bp, synthetic construct
  misc_feature 1..30: note = Synthetic Construct
  source 1..30: mol_type = other DNA
cccatgtatctcttctggtaacctactaag

SEQ ID NO: 39334 - DNA, 19 bp, synthetic construct
  misc_feature 1..19: note = Synthetic Construct
  source 1..19: mol_type = other DNA
gagttcccctgccgacttg

SEQ ID NO: 39335 - DNA, 26 bp, synthetic construct
  misc_feature 1..26: note = Synthetic Construct
  source 1..26: mol_type = other DNA
ggccctcagagatctgtattccctta

SEQ ID NO: 39336 - DNA, 19 bp, synthetic construct
  misc_feature 1..19: note = Synthetic Construct
  source 1..19: mol_type = other DNA
tgggcgagcacttgctact

SEQ ID NO: 39337 - DNA, 26 bp, synthetic construct
  misc_feature 1..26: note = Synthetic Construct
  source 1..26: mol_type = other DNA
ggggacatgtttgatgtccagacaga

SEQ ID NO: 39338 - DNA, 25 bp, synthetic construct
  misc_feature 1..25: note = Synthetic Construct
  source 1..25: mol_type = other DNA
gcttttactccctgtgtttttggaa

SEQ ID NO: 39339 - DNA, 24 bp, synthetic construct
  misc_feature 1..24: note = Synthetic Construct
  source 1..24: mol_type = other DNA
gggtctagacaggcctgagttcta

SEQ ID NO: 39340 - DNA, 22 bp, synthetic construct
  misc_feature 1..22: note = Synthetic Construct
  source 1..22: mol_type = other DNA
agaaagaggtgggatggaggat

SEQ ID NO: 39341 - DNA, 22 bp, synthetic construct
  misc_feature 1..22: note = Synthetic Construct
  source 1..22: mol_type = other DNA
gagtgtcagttgtgtcccagaa

SEQ ID NO: 39342 - DNA, 22 bp, synthetic construct
  misc_feature 1..22: note = Synthetic Construct
  source 1..22: mol_type = other DNA
ggcgggaccagtagtcttgttt

SEQ ID NO: 39343 - DNA, 22 bp, synthetic construct
  misc_feature 1..22: note = Synthetic Construct
  source 1..22: mol_type = other DNA
gtgcacatgctctccctagaca

SEQ ID NO: 39344 - DNA, 23 bp, synthetic construct
  misc_feature 1..23: note = Synthetic Construct
  source 1..23: mol_type = other DNA
ccgtaaaccaagtggggatgtag

SEQ ID NO: 39345 - DNA, 23 bp, synthetic construct
  misc_feature 1..23: note = Synthetic Construct
  source 1..23: mol_type = other DNA
cctcagtctgtgctggtaagaga

SEQ ID NO: 39346 - DNA, 27 bp, synthetic construct
  misc_feature 1..27: note = Synthetic Construct
  source 1..27: mol_type = other DNA
ctcaacatggaattaagttgcctcctt

SEQ ID NO: 39347 - DNA, 26 bp, synthetic construct
  misc_feature 1..26: note = Synthetic Construct
  source 1..26: mol_type = other DNA
actcttatctaggattctgggccatt

SEQ ID NO: 39348 - DNA, 19 bp, synthetic construct
  misc_feature 1..19: note = Synthetic Construct
  source 1..19: mol_type = other DNA
ttggtccccgttgttgcat

SEQ ID NO: 39349 - DNA, 22 bp, synthetic construct
  misc_feature 1..22: note = Synthetic Construct
  source 1..22: mol_type = other DNA
gactggcactcctgaggaaaga

SEQ ID NO: 39350 - DNA, 20 bp, synthetic construct
  misc_feature 1..20: note = Synthetic Construct
  source 1..20: mol_type = other DNA
cctggggaggagggagatga

SEQ ID NO: 39351 - DNA, 22 bp, synthetic construct
  misc_feature 1..22: note = Synthetic Construct
  source 1..22: mol_type = other DNA
cagaacagcagttttgcaccaa

SEQ ID NO: 39352 - DNA, 22 bp, synthetic construct
  misc_feature 1..22: note = Synthetic Construct
  source 1..22: mol_type = other DNA
ggatgcactggctctgcagttt

SEQ ID NO: 39353 - DNA, 22 bp, synthetic construct
  misc_feature 1..22: note = Synthetic Construct
  source 1..22: mol_type = other DNA
ctcttggattcacggccagatg

SEQ ID NO: 39354 - DNA, 27 bp, synthetic construct
  misc_feature 1..27: note = Synthetic Construct
  source 1..27: mol_type = other DNA
ggacatgattggtttcactgtggagtt

SEQ ID NO: 39355 - DNA, 22 bp, synthetic construct
  misc_feature 1..22: note = Synthetic Construct
  source 1..22: mol_type = other DNA
acctatccttgacgtgggaagt

SEQ ID NO: 39356 - DNA, 20 bp, synthetic construct
  misc_feature 1..20: note = Synthetic Construct
  source 1..20: mol_type = other DNA
cctgcagcagcgacaatgaa

SEQ ID NO: 39357 - DNA, 25 bp, synthetic construct
  misc_feature 1..25: note = Synthetic Construct
  source 1..25: mol_type = other DNA
cctaaagggaaaaatgcagtgttga

SEQ ID NO: 39358 - DNA, 23 bp, synthetic construct
  misc_feature 1..23: note = Synthetic Construct
  source 1..23: mol_type = other DNA
ggcctaagtcagggttctgcaat

SEQ ID NO: 39359 - DNA, 20 bp, synthetic construct
  misc_feature 1..20: note = Synthetic Construct
  source 1..20: mol_type = other DNA
agtgctcaccccttccactt

SEQ ID NO: 39360 - DNA, 25 bp, synthetic construct
  misc_feature 1..25: note = Synthetic Construct
  source 1..25: mol_type = other DNA
cataactacactgcattcccactca

SEQ ID NO: 39361 - DNA, 27 bp, synthetic construct
  misc_feature 1..27: note = Synthetic Construct
  source 1..27: mol_type = other DNA
ggaactcagcttttcattgtggggaaa

SEQ ID NO: 39362 - DNA, 22 bp, synthetic construct
  misc_feature 1..22: note = Synthetic Construct
  source 1..22: mol_type = other DNA
aaacctgctgacagggtaaaca

SEQ ID NO: 39363 - DNA, 24 bp, synthetic construct
  misc_feature 1..24: note = Synthetic Construct
  source 1..24: mol_type = other DNA
cccgtgcttctaacagattggaaa

SEQ ID NO: 39364 - DNA, 24 bp, synthetic construct
  misc_feature 1..24: note = Synthetic Construct
  source 1..24: mol_type = other DNA
ccaagcaccaaggacatcctcaga

SEQ ID NO: 39365 - DNA, 22 bp, synthetic construct
  misc_feature 1..22: note = Synthetic Construct
  source 1..22: mol_type = other DNA
ttgggttgagatccagcagatg

SEQ ID NO: 39366 - DNA, 23 bp, synthetic construct
  misc_feature 1..23: note = Synthetic Construct
  source 1..23: mol_type = other DNA
ggtgcttacatggttctgagcaa

SEQ ID NO: 39367 - DNA, 25 bp, synthetic construct
  misc_feature 1..25: note = Synthetic Construct
  source 1..25: mol_type = other DNA
ctgggataagagctagagtgctaag

SEQ ID NO: 39368 - DNA, 28 bp, synthetic construct
  misc_feature 1..28: note = Synthetic Construct
  source 1..28: mol_type = other DNA
gacttaagaaggcattaccagctactga

SEQ ID NO: 39369 - DNA, 21 bp, synthetic construct
  misc_feature 1..21: note = Synthetic Construct
  source 1..21: mol_type = other DNA
ctggccacaccaagaatggtt

SEQ ID NO: 39370 - DNA, 22 bp, synthetic construct
  misc_feature 1..22: note = Synthetic Construct
  source 1..22: mol_type = other DNA
ccagctgccagaggtttcacat

SEQ ID NO: 39371 - DNA, 28 bp, synthetic construct
  misc_feature 1..28: note = Synthetic Construct
  source 1..28: mol_type = other DNA
ggttggaatatgaatgtggaggggatga

SEQ ID NO: 39372 - DNA, 25 bp, synthetic construct
  misc_feature 1..25: note = Synthetic Construct
  source 1..25: mol_type = other DNA
ataccaaaggctgttcttcaacaag

SEQ ID NO: 39373 - DNA, 24 bp, synthetic construct
  misc_feature 1..24: note = Synthetic Construct
  source 1..24: mol_type = other DNA
tcccactcactttccaggattaga

SEQ ID NO: 39374 - DNA, 20 bp, synthetic construct
  misc_feature 1..20: note = Synthetic Construct
  source 1..20: mol_type = other DNA
atgcatcccgccaagtcagt

SEQ ID NO: 39375 - DNA, 23 bp, synthetic construct
  misc_feature 1..23: note = Synthetic Construct
  source 1..23: mol_type = other DNA
tgccatttttgctcctctctttg

SEQ ID NO: 39376 - DNA, 22 bp, synthetic construct
  misc_feature 1..22: note = Synthetic Construct
  source 1..22: mol_type = other DNA
cactgcatccactctcgtgtct

SEQ ID NO: 39377 - DNA, 20 bp, synthetic construct
  misc_feature 1..20: note = Synthetic Construct
  source 1..20: mol_type = other DNA
tccttgaagcccacatgcaa

SEQ ID NO: 39378 - DNA, 22 bp, synthetic construct
  misc_feature 1..22: note = Synthetic Construct
  source 1..22: mol_type = other DNA
tgaggaccgagattttgccttt

SEQ ID NO: 39379 - DNA, 27 bp, synthetic construct
  misc_feature 1..27: note = Synthetic Construct
  source 1..27: mol_type = other DNA
gcattagtactgcagagataccgatac

SEQ ID NO: 39380 - DNA, 20 bp, synthetic construct
  misc_feature 1..20: note = Synthetic Construct
  source 1..20: mol_type = other DNA
atggtctggctgcctgttct

SEQ ID NO: 39381 - DNA, 20 bp, synthetic construct
  misc_feature 1..20: note = Synthetic Construct
  source 1..20: mol_type = other DNA
aggcccagcttagctcttca

SEQ ID NO: 39382 - DNA, 24 bp, synthetic construct
  misc_feature 1..24: note = Synthetic Construct
  source 1..24: mol_type = other DNA
tctgggaccaaagtgaacctaaag

SEQ ID NO: 39383 - DNA, 26 bp, synthetic construct
  misc_feature 1..26: note = Synthetic Construct
  source 1..26: mol_type = other DNA
ggttcagaaaatggcccttcctttag

SEQ ID NO: 39384 - DNA, 20 bp, synthetic construct
  misc_feature 1..20: note = Synthetic Construct
  source 1..20: mol_type = other DNA
tgcacaggctgcagcataac

SEQ ID NO: 39385 - DNA, 23 bp, synthetic construct
  misc_feature 1..23: note = Synthetic Construct
  source 1..23: mol_type = other DNA
ccacccaggctgaggtcattaag

SEQ ID NO: 39386 - DNA, 23 bp, synthetic construct
  misc_feature 1..23: note = Synthetic Construct
  source 1..23: mol_type = other DNA
cgggaccttgatttcggagatag

SEQ ID NO: 39387 - DNA, 25 bp, synthetic construct
  misc_feature 1..25: note = Synthetic Construct
  source 1..25: mol_type = other DNA
gggagtagacacataccctctcttc

SEQ ID NO: 39388 - DNA, 28 bp, synthetic construct
  misc_feature 1..28: note = Synthetic Construct
  source 1..28: mol_type = other DNA
cctctggattaggtaatgaggcagagaa

SEQ ID NO: 39389 - DNA, 27 bp, synthetic construct
  misc_feature 1..27: note = Synthetic Construct
  source 1..27: mol_type = other DNA
gctaagcatgtcagaattccaggtctt

SEQ ID NO: 39390 - DNA, 19 bp, synthetic construct
  misc_feature 1..19: note = Synthetic Construct
  source 1..19: mol_type = other DNA
agccgtcatccagccaagt

SEQ ID NO: 39391 - DNA, 20 bp, synthetic construct
  misc_feature 1..20: note = Synthetic Construct
  source 1..20: mol_type = other DNA
cccagtttccaggggtgtgt

SEQ ID NO: 39392 - DNA, 24 bp, synthetic construct
  misc_feature 1..24: note = Synthetic Construct
  source 1..24: mol_type = other DNA
gactaagtgtgttgcctctgtttg

SEQ ID NO: 39393 - DNA, 24 bp, synthetic construct
  misc_feature 1..24: note = Synthetic Construct
  source 1..24: mol_type = other DNA
ggcataggtttgacaggagtgtta

SEQ ID NO: 39394 - DNA, 27 bp, synthetic construct
  misc_feature 1..27: note = Synthetic Construct
  source 1..27: mol_type = other DNA
gagaattatacatcactggctctctga

SEQ ID NO: 39395 - DNA, 21 bp, synthetic construct
  misc_feature 1..21: note = Synthetic Construct
  source 1..21: mol_type = other DNA
agcatgcatgtggctctcaaa

SEQ ID NO: 39396 - DNA, 22 bp, synthetic construct
  misc_feature 1..22: note = Synthetic Construct
  source 1..22: mol_type = other DNA
acaagccccatatctgcctact

SEQ ID NO: 39397 - DNA, 24 bp, synthetic construct
  misc_feature 1..24: note = Synthetic Construct
  source 1..24: mol_type = other DNA
gccttcccatctgtgagcttgttc

SEQ ID NO: 39398 - DNA, 25 bp, synthetic construct
  misc_feature 1..25: note = Synthetic Construct
  source 1..25: mol_type = other DNA
ctgcagtcagacattgcaaagagtt

SEQ ID NO: 39399 - DNA, 20 bp, synthetic construct
  misc_feature 1..20: note = Synthetic Construct
  source 1..20: mol_type = other DNA
gggtgagggcatgggacttc

SEQ ID NO: 39400 - DNA, 22 bp, synthetic construct
  misc_feature 1..22: note = Synthetic Construct
  source 1..22: mol_type = other DNA
ggtcccacatggctcttccaaa

SEQ ID NO: 39401 - DNA, 24 bp, synthetic construct
  misc_feature 1..24: note = Synthetic Construct
  source 1..24: mol_type = other DNA
ggagctaaagggactgcaggatac

SEQ ID NO: 39402 - DNA, 25 bp, synthetic construct
  misc_feature 1..25: note = Synthetic Construct
  source 1..25: mol_type = other DNA
tgccaacaaccactagaaattggat

SEQ ID NO: 39403 - DNA, 26 bp, synthetic construct
  misc_feature 1..26: note = Synthetic Construct
  source 1..26: mol_type = other DNA
ctgatatccaaatcgatgccaactct

SEQ ID NO: 39404 - DNA, 21 bp, synthetic construct
  misc_feature 1..21: note = Synthetic Construct
  source 1..21: mol_type = other DNA
gcgtgattaggactggctaca

SEQ ID NO: 39405 - DNA, 26 bp, synthetic construct
  misc_feature 1..26: note = Synthetic Construct
  source 1..26: mol_type = other DNA
ggaggagaggagagatggatggattc

SEQ ID NO: 39406 - DNA, 22 bp, synthetic construct
  misc_feature 1..22: note = Synthetic Construct
  source 1..22: mol_type = other DNA
ttccccaagatgcctctagact

SEQ ID NO: 39407 - DNA, 21 bp, synthetic construct
  misc_feature 1..21: note = Synthetic Construct
  source 1..21: mol_type = other DNA
tggattcagccggacttgatg

SEQ ID NO: 39408 - DNA, 23 bp, synthetic construct
  misc_feature 1..23: note = Synthetic Construct
  source 1..23: mol_type = other DNA
ctctcagtgacttcgcacaagtt

SEQ ID NO: 39409 - DNA, 20 bp, synthetic construct
  misc_feature 1..20: note = Synthetic Construct
  source 1..20: mol_type = other DNA
gtcacgcagcacagaggaaa

SEQ ID NO: 39410 - DNA, 21 bp, synthetic construct
  misc_feature 1..21: note = Synthetic Construct
  source 1..21: mol_type = other DNA
agtagagagccagtgggaaca

SEQ ID NO: 39411 - DNA, 20 bp, synthetic construct
  misc_feature 1..20: note = Synthetic Construct
  source 1..20: mol_type = other DNA
acgtgttggctggagcatgt

SEQ ID NO: 39412 - DNA, 24 bp, synthetic construct
  misc_feature 1..24: note = Synthetic Construct
  source 1..24: mol_type = other DNA
ggcaacattttccaacacccaact

SEQ ID NO: 39413 - DNA, 18 bp, synthetic construct
  misc_feature 1..18: note = Synthetic Construct
  source 1..18: mol_type = other DNA
actcgggcgtggaactgt

SEQ ID NO: 39414 - DNA, 21 bp, synthetic construct
  misc_feature 1..21: note = Synthetic Construct
  source 1..21: mol_type = other DNA
aggggtacccattctgcatgt

SEQ ID NO: 39415 - DNA, 22 bp, synthetic construct
  misc_feature 1..22: note = Synthetic Construct
  source 1..22: mol_type = other DNA
tctccagctgggtgtctctatc

SEQ ID NO: 39416 - DNA, 23 bp, synthetic construct
  misc_feature 1..23: note = Synthetic Construct
  source 1..23: mol_type = other DNA
aattccctcatctggggctttag

SEQ ID NO: 39417 - DNA, 23 bp, synthetic construct
  misc_feature 1..23: note = Synthetic Construct
  source 1..23: mol_type = other DNA
gaggtctcccaaacacctacaga

SEQ ID NO: 39418 - DNA, 24 bp, synthetic construct
  misc_feature 1..24: note = Synthetic Construct
  source 1..24: mol_type = other DNA
agcactcaataaactcagctgcta

SEQ ID NO: 39419 - DNA, 26 bp, synthetic construct
  misc_feature 1..26: note = Synthetic Construct
  source 1..26: mol_type = other DNA
cagttaggaccacaatcaaaccatac

SEQ ID NO: 39420 - DNA, 22 bp, synthetic construct
  misc_feature 1..22: note = Synthetic Construct
  source 1..22: mol_type = other DNA
gtcctctcggcccacttaattc

SEQ ID NO: 39421 - DNA, 24 bp, synthetic construct
  misc_feature 1..24: note = Synthetic Construct
  source 1..24: mol_type = other DNA
ccactggcttctgggaatttctac

SEQ ID NO: 39422 - DNA, 21 bp, synthetic construct
  misc_feature 1..21: note = Synthetic Construct
  source 1..21: mol_type = other DNA
accagatggcattggggattc

SEQ ID NO: 39423 - DNA, 21 bp, synthetic construct
  misc_feature 1..21: note = Synthetic Construct
  source 1..21: mol_type = other DNA
cccctgctccaaacacaccat

SEQ ID NO: 39424 - DNA, 20 bp, synthetic construct
  misc_feature 1..20: note = Synthetic Construct
  source 1..20: mol_type = other DNA
tttgtggttgccgccctttg

SEQ ID NO: 39425 - DNA, 27 bp, synthetic construct
  misc_feature 1..27: note = Synthetic Construct
  source 1..27: mol_type = other DNA
caaggataactttccactctgcttttg

SEQ ID NO: 39426 - DNA, 22 bp, synthetic construct
  misc_feature 1..22: note = Synthetic Construct
  source 1..22: mol_type = other DNA
cggagagccatctgccatatct

SEQ ID NO: 39427 - DNA, 21 bp, synthetic construct
  misc_feature 1..21: note = Synthetic Construct
  source 1..21: mol_type = other DNA
cgcctcttaagccaagggaat

SEQ ID NO: 39428 - DNA, 22 bp, synthetic construct
  misc_feature 1..22: note = Synthetic Construct
  source 1..22: mol_type = other DNA
caaatcccgccgagtgatctta

SEQ ID NO: 39429 - DNA, 27 bp, synthetic construct
  misc_feature 1..27: note = Synthetic Construct
  source 1..27: mol_type = other DNA
tttcctagatagaatcctggggtatgt

SEQ ID NO: 39430 - DNA, 22 bp, synthetic construct
  misc_feature 1..22: note = Synthetic Construct
  source 1..22: mol_type = other DNA
aagacacaacgaggctaaccaa

SEQ ID NO: 39431 - DNA, 24 bp, synthetic construct
  misc_feature 1..24: note = Synthetic Construct
  source 1..24: mol_type = other DNA
gtgaagcatttccagcttgcatca

SEQ ID NO: 39432 - DNA, 20 bp, synthetic construct
  misc_feature 1..20: note = Synthetic Construct
  source 1..20: mol_type = other DNA
ttgacagcggcttcctgatg

SEQ ID NO: 39433 - DNA, 24 bp, synthetic construct
  misc_feature 1..24: note = Synthetic Construct
  source 1..24: mol_type = other DNA
ggatcaggtttgccatcctctact

SEQ ID NO: 39434 - DNA, 23 bp, synthetic construct
  misc_feature 1..23: note = Synthetic Construct
  source 1..23: mol_type = other DNA
gctgcttttcagaactgctctct

SEQ ID NO: 39435 - DNA, 20 bp, synthetic construct
  misc_feature 1..20: note = Synthetic Construct
  source 1..20: mol_type = other DNA
agggcactccagaagcagtt

SEQ ID NO: 39436 - DNA, 20 bp, synthetic construct
  misc_feature 1..20: note = Synthetic Construct
  source 1..20: mol_type = other DNA
gagcatcggcgaagcactaa

SEQ ID NO: 39437 - DNA, 20 bp, synthetic construct
  misc_feature 1..20: note = Synthetic Construct
  source 1..20: mol_type = other DNA
tcccagctgctccttagctt

SEQ ID NO: 39438 - DNA, 22 bp, synthetic construct
  misc_feature 1..22: note = Synthetic Construct
  source 1..22: mol_type = other DNA
ttggccaatggaatcacagagt

SEQ ID NO: 39439 - DNA, 24 bp, synthetic construct
  misc_feature 1..24: note = Synthetic Construct
  source 1..24: mol_type = other DNA
ggacagcaaagagtccaagcagat

SEQ ID NO: 39440 - DNA, 20 bp, synthetic construct
  misc_feature 1..20: note = Synthetic Construct
  source 1..20: mol_type = other DNA
ttcccagcgagaacgaccat

SEQ ID NO: 39441 - DNA, 29 bp, synthetic construct
  misc_feature 1..29: note = Synthetic Construct
  source 1..29: mol_type = other DNA
cagacttcaattgcctatgtcacttctct

SEQ ID NO: 39442 - DNA, 22 bp, synthetic construct
  misc_feature 1..22: note = Synthetic Construct
  source 1..22: mol_type = other DNA
tgggactgtgaggccagaaatg

SEQ ID NO: 39443 - DNA, 27 bp, synthetic construct
  misc_feature 1..27: note = Synthetic Construct
  source 1..27: mol_type = other DNA
tctaagtcctgtcttgcattagagttg

SEQ ID NO: 39444 - DNA, 22 bp, synthetic construct
  misc_feature 1..22: note = Synthetic Construct
  source 1..22: mol_type = other DNA
accgggacacccataggcaata

SEQ ID NO: 39445 - DNA, 24 bp, synthetic construct
  misc_feature 1..24: note = Synthetic Construct
  source 1..24: mol_type = other DNA
cgtcacattacacctcctgtcact

SEQ ID NO: 39446 - DNA, 23 bp, synthetic construct
  misc_feature 1..23: note = Synthetic Construct
  source 1..23: mol_type = other DNA
gtggtgtctacagtgtgctggtt

SEQ ID NO: 39447 - DNA, 29 bp, synthetic construct
  misc_feature 1..29: note = Synthetic Construct
  source 1..29: mol_type = other DNA
ccactcctcattaaaagcaaacacagctt

SEQ ID NO: 39448 - DNA, 26 bp, synthetic construct
  misc_feature 1..26: note = Synthetic Construct
  source 1..26: mol_type = other DNA
cctttacttgtgtgaagtcagtgttc

SEQ ID NO: 39449 - DNA, 22 bp, synthetic construct
  misc_feature 1..22: note = Synthetic Construct
  source 1..22: mol_type = other DNA
gaccagaacagggacctctcta

SEQ ID NO: 39450 - DNA, 19 bp, synthetic construct
  misc_feature 1..19: note = Synthetic Construct
  source 1..19: mol_type = other DNA
acacccgcaaaagccagat

SEQ ID NO: 39451 - DNA, 20 bp, synthetic construct
  misc_feature 1..20: note = Synthetic Construct
  source 1..20: mol_type = other DNA
acagaggccccaggcttcat

SEQ ID NO: 39452 - DNA, 25 bp, synthetic construct
  misc_feature 1..25: note = Synthetic Construct
  source 1..25: mol_type = other DNA
cccactcggttacaatttgttggtt

SEQ ID NO: 39453 - DNA, 22 bp, synthetic construct
  misc_feature 1..22: note = Synthetic Construct
  source 1..22: mol_type = other DNA
ggggtcgatttggtagccttag

SEQ ID NO: 39454 - DNA, 24 bp, synthetic construct
  misc_feature 1..24: note = Synthetic Construct
  source 1..24: mol_type = other DNA
gacaaagttagcaggtagcgaatc

SEQ ID NO: 39455 - DNA, 24 bp, synthetic construct
  misc_feature 1..24: note = Synthetic Construct
  source 1..24: mol_type = other DNA
aatgttggaaccaatgtccctttg

SEQ ID NO: 39456 - DNA, 22 bp, synthetic construct
  misc_feature 1..22: note = Synthetic Construct
  source 1..22: mol_type = other DNA
ctgagattcccacagcaacact

SEQ ID NO: 39457 - DNA, 22 bp, synthetic construct
  misc_feature 1..22: note = Synthetic Construct
  source 1..22: mol_type = other DNA
tcccttacctccacccaacact

SEQ ID NO: 39458 - DNA, 22 bp, synthetic construct
  misc_feature 1..22: note = Synthetic Construct
  source 1..22: mol_type = other DNA
gccagcagacttgccttctttg

SEQ ID NO: 39459 - DNA, 20 bp, synthetic construct
  misc_feature 1..20: note = Synthetic Construct
  source 1..20: mol_type = other DNA
cctgtcactgcttggcatgt

SEQ ID NO: 39460 - DNA, 21 bp, synthetic construct
  misc_feature 1..21: note = Synthetic Construct
  source 1..21: mol_type = other DNA
tggtggatgggcgggactaat

SEQ ID NO: 39461 - DNA, 20 bp, synthetic construct
  misc_feature 1..20: note = Synthetic Construct
  source 1..20: mol_type = other DNA
acagcctacaccgcgttttc

SEQ ID NO: 39462 - DNA, 22 bp, synthetic construct
  misc_feature 1..22: note = Synthetic Construct
  source 1..22: mol_type = other DNA
ggtggaaaggcttgcgacattc

SEQ ID NO: 39463 - DNA, 25 bp, synthetic construct
  misc_feature 1..25: note = Synthetic Construct
  source 1..25: mol_type = other DNA
ggaagcagaacctagaactgtccat

SEQ ID NO: 39464 - DNA, 28 bp, synthetic construct
  misc_feature 1..28: note = Synthetic Construct
  source 1..28: mol_type = other DNA
ggttctgaatgggctgtgtcttacttat

SEQ ID NO: 39465 - DNA, 26 bp, synthetic construct
  misc_feature 1..26: note = Synthetic Construct
  source 1..26: mol_type = other DNA
gtgcagctgaagtaaagtaacctaga

SEQ ID NO: 39466 - DNA, 21 bp, synthetic construct
  misc_feature 1..21: note = Synthetic Construct
  source 1..21: mol_type = other DNA
ctctgttcggtgagagcaact

SEQ ID NO: 39467 - DNA, 21 bp, synthetic construct
  misc_feature 1..21: note = Synthetic Construct
  source 1..21: mol_type = other DNA
gacatttggtgcagctgtgtt

SEQ ID NO: 39468 - DNA, 25 bp, synthetic construct
  misc_feature 1..25: note = Synthetic Construct
  source 1..25: mol_type = other DNA
cactccatcctctccttccatctga

SEQ ID NO: 39469 - DNA, 24 bp, synthetic construct
  misc_feature 1..24: note = Synthetic Construct
  source 1..24: mol_type = other DNA
actgtaactcagttgcctctttca

SEQ ID NO: 39470 - DNA, 21 bp, synthetic construct
  misc_feature 1..21: note = Synthetic Construct
  source 1..21: mol_type = other DNA
tccaccctccagcctgacaat

SEQ ID NO: 39471 - DNA, 20 bp, synthetic construct
  misc_feature 1..20: note = Synthetic Construct
  source 1..20: mol_type = other DNA
tggaagtgggaggggacaca

SEQ ID NO: 39472 - DNA, 21 bp, synthetic construct
  misc_feature 1..21: note = Synthetic Construct
  source 1..21: mol_type = other DNA
tgccgtgaaacctccatttct

SEQ ID NO: 39473 - DNA, 24 bp, synthetic construct
  misc_feature 1..24: note = Synthetic Construct
  source 1..24: mol_type = other DNA
gggagagacagctaagtccctaag

SEQ ID NO: 39474 - DNA, 20 bp, synthetic construct
  misc_feature 1..20: note = Synthetic Construct
  source 1..20: mol_type = other DNA
acacagggctgcagtgttca

SEQ ID NO: 39475 - DNA, 22 bp, synthetic construct
  misc_feature 1..22: note = Synthetic Construct
  source 1..22: mol_type = other DNA
ctcataaagctggccctggatt

SEQ ID NO: 39476 - DNA, 24 bp, synthetic construct
  misc_feature 1..24: note = Synthetic Construct
  source 1..24: mol_type = other DNA
cccgaggagctcagttgtatggtt

SEQ ID NO: 39477 - DNA, 30 bp, synthetic construct
  misc_feature 1..30: note = Synthetic Construct
  source 1..30: mol_type = other DNA
gacaacccagtaaagttgtttctcacattg

SEQ ID NO: 39478 - DNA, 24 bp, synthetic construct
  misc_feature 1..24: note = Synthetic Construct
  source 1..24: mol_type = other DNA
gtccagtgggtgaatggcctataa

SEQ ID NO: 39479 - DNA, 21 bp, synthetic construct
  misc_feature 1..21: note = Synthetic Construct
  source 1..21: mol_type = other DNA
gccttggatgaagctgccttt

SEQ ID NO: 39480 - DNA, 21 bp, synthetic construct
  misc_feature 1..21: note = Synthetic Construct
  source 1..21: mol_type = other DNA
aggaaccagtggctgccatca

SEQ ID NO: 39481 - DNA, 24 bp, synthetic construct
  misc_feature 1..24: note = Synthetic Construct
  source 1..24: mol_type = other DNA
gctggtaagtctctgccgatcaac

SEQ ID NO: 39482 - DNA, 22 bp, synthetic construct
  misc_feature 1..22: note = Synthetic Construct
  source 1..22: mol_type = other DNA
tggctgaggaggggacatgtta

SEQ ID NO: 39483 - DNA, 21 bp, synthetic construct
  misc_feature 1..21: note = Synthetic Construct
  source 1..21: mol_type = other DNA
gcaggtggggtacaccatgaa

SEQ ID NO: 39484 - DNA, 20 bp, synthetic construct
  misc_feature 1..20: note = Synthetic Construct
  source 1..20: mol_type = other DNA
aacgcaggtctggctgattc

SEQ ID NO: 39485 - DNA, 19 bp, synthetic construct
  misc_feature 1..19: note = Synthetic Construct
  source 1..19: mol_type = other DNA
gctggttgggtgacagcaa

SEQ ID NO: 39486 - DNA, 25 bp, synthetic construct
  misc_feature 1..25: note = Synthetic Construct
  source 1..25: mol_type = other DNA
gagttttcataccaccgtagaccat

SEQ ID NO: 39487 - DNA, 27 bp, synthetic construct
  misc_feature 1..27: note = Synthetic Construct
  source 1..27: mol_type = other DNA
gtggatcatgttataggatggggtcat

SEQ ID NO: 39488 - DNA, 25 bp, synthetic construct
  misc_feature 1..25: note = Synthetic Construct
  source 1..25: mol_type = other DNA
ttggccaactgtaacatgtagtttc

SEQ ID NO: 39489 - DNA, 20 bp, synthetic construct
  misc_feature 1..20: note = Synthetic Construct
  source 1..20: mol_type = other DNA
aggccagggtgctctgttga

SEQ ID NO: 39490 - DNA, 23 bp, synthetic construct
  misc_feature 1..23: note = Synthetic Construct
  source 1..23: mol_type = other DNA
gtagacagagcatccctggtttc

SEQ ID NO: 39491 - DNA, 20 bp, synthetic construct
  misc_feature 1..20: note = Synthetic Construct
  source 1..20: mol_type = other DNA
ggggcttccacagcttcttt

SEQ ID NO: 39492 - DNA, 18 bp, synthetic construct
  misc_feature 1..18: note = Synthetic Construct
  source 1..18: mol_type = other DNA
tggctcgcgatgccttct

SEQ ID NO: 39493 - DNA, 23 bp, synthetic construct
  misc_feature 1..23: note = Synthetic Construct
  source 1..23: mol_type = other DNA
cttgcagctacatcaaggggaaa

SEQ ID NO: 39494 - DNA, 22 bp, synthetic construct
  misc_feature 1..22: note = Synthetic Construct
  source 1..22: mol_type = other DNA
ggtttctagccccagcttgtgt

SEQ ID NO: 39495 - DNA, 22 bp, synthetic construct
  misc_feature 1..22: note = Synthetic Construct
  source 1..22: mol_type = other DNA
cttgcctccttgctcaagaaac

SEQ ID NO: 39496 - DNA, 22 bp, synthetic construct
  misc_feature 1..22: note = Synthetic Construct
  source 1..22: mol_type = other DNA
agtgagagtctctgggaaccaa

SEQ ID NO: 39497 - DNA, 22 bp, synthetic construct
  misc_feature 1..22: note = Synthetic Construct
  source 1..22: mol_type = other DNA
ctgtacccagctcaaagtcagt

SEQ ID NO: 39498 - DNA, 22 bp, synthetic construct
  misc_feature 1..22: note = Synthetic Construct
  source 1..22: mol_type = other DNA
cccttccacttcctcgcttagt

SEQ ID NO: 39499 - DNA, 23 bp, synthetic construct
  misc_feature 1..23: note = Synthetic Construct
  source 1..23: mol_type = other DNA
ccaagatacaccttgcccctctt

SEQ ID NO: 39500 - DNA, 22 bp, synthetic construct
  misc_feature 1..22: note = Synthetic Construct
  source 1..22: mol_type = other DNA
gcaccctggaacttggtcaatc

SEQ ID NO: 39501 - DNA, 30 bp, synthetic construct
  misc_feature 1..30: note = Synthetic Construct
  source 1..30: mol_type = other DNA
gagaaatatcttaaggctcgtgttctgtca

SEQ ID NO: 39502 - DNA, 22 bp, synthetic construct
  misc_feature 1..22: note = Synthetic Construct
  source 1..22: mol_type = other DNA
ctttctcccaagcaaggaggat

SEQ ID NO: 39503 - DNA, 22 bp, synthetic construct
  misc_feature 1..22: note = Synthetic Construct
  source 1..22: mol_type = other DNA
cacccaatgttcaccccaaagt

SEQ ID NO: 39504 - DNA, 25 bp, synthetic construct
  misc_feature 1..25: note = Synthetic Construct
  source 1..25: mol_type = other DNA
tgtatagacctggagtacacagtca

SEQ ID NO: 39505 - DNA, 24 bp, synthetic construct
  misc_feature 1..24: note = Synthetic Construct
  source 1..24: mol_type = other DNA
gcagctaggcaagaggatgagaag

SEQ ID NO: 39506 - DNA, 25 bp, synthetic construct
  misc_feature 1..25: note = Synthetic Construct
  source 1..25: mol_type = other DNA
gcataaacccaggtccctttaggtt

SEQ ID NO: 39507 - DNA, 22 bp, synthetic construct
  misc_feature 1..22: note = Synthetic Construct
  source 1..22: mol_type = other DNA
ccacagcagccactgttctttc

SEQ ID NO: 39508 - DNA, 20 bp, synthetic construct
  misc_feature 1..20: note = Synthetic Construct
  source 1..20: mol_type = other DNA
tcgtctctatgggccgcaat

SEQ ID NO: 39509 - DNA, 23 bp, synthetic construct
  misc_feature 1..23: note = Synthetic Construct
  source 1..23: mol_type = other DNA
ctgcaagcatgcactcatagaga

SEQ ID NO: 39510 - DNA, 23 bp, synthetic construct
  misc_feature 1..23: note = Synthetic Construct
  source 1..23: mol_type = other DNA
ggggatacttggtaggacacact

SEQ ID NO: 39511 - DNA, 25 bp, synthetic construct
  misc_feature 1..25: note = Synthetic Construct
  source 1..25: mol_type = other DNA
ggatagcaaatacactgcagcacaa

SEQ ID NO: 39512 - DNA, 23 bp, synthetic construct
  misc_feature 1..23: note = Synthetic Construct
  source 1..23: mol_type = other DNA
cccttttgaggtgtccttactgt

SEQ ID NO: 39513 - DNA, 22 bp, synthetic construct
  misc_feature 1..22: note = Synthetic Construct
  source 1..22: mol_type = other DNA
cacatggaacagagccatggaa

SEQ ID NO: 39514 - DNA, 23 bp, synthetic construct
  misc_feature 1..23: note = Synthetic Construct
  source 1..23: mol_type = other DNA
gggaaaggtacagcacgtttatg

SEQ ID NO: 39515 - DNA, 24 bp, synthetic construct
  misc_feature 1..24: note = Synthetic Construct
  source 1..24: mol_type = other DNA
ctgaccacacaacctctgttggaa

SEQ ID NO: 39516 - DNA, 25 bp, synthetic construct
  misc_feature 1..25: note = Synthetic Construct
  source 1..25: mol_type = other DNA
gtggaacgtgtctaattccctcaca

SEQ ID NO: 39517 - DNA, 23 bp, synthetic construct
  misc_feature 1..23: note = Synthetic Construct
  source 1..23: mol_type = other DNA
gctgagataggaacgctgtcagt

SEQ ID NO: 39518 - DNA, 24 bp, synthetic construct
  misc_feature 1..24: note = Synthetic Construct
  source 1..24: mol_type = other DNA
tgacagcagtatccagagacttga

SEQ ID NO: 39519 - DNA, 21 bp, synthetic construct
  misc_feature 1..21: note = Synthetic Construct
  source 1..21: mol_type = other DNA
acaggatgaacaaggcggatt

SEQ ID NO: 39520 - DNA, 25 bp, synthetic construct
  misc_feature 1..25: note = Synthetic Construct
  source 1..25: mol_type = other DNA
gacatgaaggtaagagcaagtcaac

SEQ ID NO: 39521 - DNA, 29 bp, synthetic construct
  misc_feature 1..29: note = Synthetic Construct
  source 1..29: mol_type = other DNA
gacattacctaatcagagcatcagcttct

SEQ ID NO: 39522 - DNA, 21 bp, synthetic construct
  misc_feature 1..21: note = Synthetic Construct
  source 1..21: mol_type = other DNA
gggaaggtggcaaagacttgt

SEQ ID NO: 39523 - DNA, 21 bp, synthetic construct
  misc_feature 1..21: note = Synthetic Construct
  source 1..21: mol_type = other DNA
ccactgggtccagttgtggat

SEQ ID NO: 39524 - DNA, 24 bp, synthetic construct
  misc_feature 1..24: note = Synthetic Construct
  source 1..24: mol_type = other DNA
aagttgtctgtccacttccctaag

SEQ ID NO: 39525 - DNA, 27 bp, synthetic construct
  misc_feature 1..27: note = Synthetic Construct
  source 1..27: mol_type = other DNA
ggaagtttttgcagtagtgggtctaac

SEQ ID NO: 39526 - DNA, 21 bp, synthetic construct
  misc_feature 1..21: note = Synthetic Construct
  source 1..21: mol_type = other DNA
ggctgcattacagaccactga

SEQ ID NO: 39527 - DNA, 23 bp, synthetic construct
  misc_feature 1..23: note = Synthetic Construct
  source 1..23: mol_type = other DNA
gggacttgtctactccagagtgt

SEQ ID NO: 39528 - DNA, 25 bp, synthetic construct
  misc_feature 1..25: note = Synthetic Construct
  source 1..25: mol_type = other DNA
gtgaacatggctctcaggagacttt

SEQ ID NO: 39529 - DNA, 22 bp, synthetic construct
  misc_feature 1..22: note = Synthetic Construct
  source 1..22: mol_type = other DNA
tgtctccccagtttggggctta

SEQ ID NO: 39530 - DNA, 21 bp, synthetic construct
  misc_feature 1..21: note = Synthetic Construct
  source 1..21: mol_type = other DNA
tgccaccacacctggttccta

SEQ ID NO: 39531 - DNA, 22 bp, synthetic construct
  misc_feature 1..22: note = Synthetic Construct
  source 1..22: mol_type = other DNA
acgaacccatgctgggaatatg

SEQ ID NO: 39532 - DNA, 23 bp, synthetic construct
  misc_feature 1..23: note = Synthetic Construct
  source 1..23: mol_type = other DNA
gcagggagaagaggaaaggttca

SEQ ID NO: 39533 - DNA, 23 bp, synthetic construct
  misc_feature 1..23: note = Synthetic Construct
  source 1..23: mol_type = other DNA
cagccaatgttccagaacgctaa

SEQ ID NO: 39534 - DNA, 21 bp, synthetic construct
  misc_feature 1..21: note = Synthetic Construct
  source 1..21: mol_type = other DNA
tccctcacccctctactggaa

SEQ ID NO: 39535 - DNA, 25 bp, synthetic construct
  misc_feature 1..25: note = Synthetic Construct
  source 1..25: mol_type = other DNA
gggatgtcagggaacaaaagcaatc

SEQ ID NO: 39536 - DNA, 22 bp, synthetic construct
  misc_feature 1..22: note = Synthetic Construct
  source 1..22: mol_type = other DNA
ccagtgggtggagatgctaaga

SEQ ID NO: 39537 - DNA, 26 bp, synthetic construct
  misc_feature 1..26: note = Synthetic Construct
  source 1..26: mol_type = other DNA
ccagatgcccacttgataacaacaca

SEQ ID NO: 39538 - DNA, 19 bp, synthetic construct
  misc_feature 1..19: note = Synthetic Construct
  source 1..19: mol_type = other DNA
agcccctctggacctcagt

SEQ ID NO: 39539 - DNA, 20 bp, synthetic construct
  misc_feature 1..20: note = Synthetic Construct
  source 1..20: mol_type = other DNA
acaacccctgtgggctccaa

SEQ ID NO: 39540 - DNA, 23 bp, synthetic construct
  misc_feature 1..23: note = Synthetic Construct
  source 1..23: mol_type = other DNA
ttctgtaaggggcacatggatac

SEQ ID NO: 39541 - DNA, 19 bp, synthetic construct
  misc_feature 1..19: note = Synthetic Construct
  source 1..19: mol_type = other DNA
ggggccatcaggactggaa

SEQ ID NO: 39542 - DNA, 20 bp, synthetic construct
  misc_feature 1..20: note = Synthetic Construct
  source 1..20: mol_type = other DNA
acctctgtggggcgtgtcaa

SEQ ID NO: 39543 - DNA, 26 bp, synthetic construct
  misc_feature 1..26: note = Synthetic Construct
  source 1..26: mol_type = other DNA
cctttacatttctccagtaggtcaca

SEQ ID NO: 39544 - DNA, 27 bp, synthetic construct
  misc_feature 1..27: note = Synthetic Construct
  source 1..27: mol_type = other DNA
cctcaaagtctagcaatcagtgggtat

SEQ ID NO: 39545 - DNA, 21 bp, synthetic construct
  misc_feature 1..21: note = Synthetic Construct
  source 1..21: mol_type = other DNA
agctacgagctgaggatcaca

SEQ ID NO: 39546 - DNA, 23 bp, synthetic construct
  misc_feature 1..23: note = Synthetic Construct
  source 1..23: mol_type = other DNA
gtgtgtttgctgtgaggctacaa

SEQ ID NO: 39547 - DNA, 30 bp, synthetic construct
  misc_feature 1..30: note = Synthetic Construct
  source 1..30: mol_type = other DNA
ccctgtcttttaaaaccttaccatcagttc

SEQ ID NO: 39548 - DNA, 21 bp, synthetic construct
  misc_feature 1..21: note = Synthetic Construct
  source 1..21: mol_type = other DNA
tgtgaggaaggcgggaggaaa

SEQ ID NO: 39549 - DNA, 25 bp, synthetic construct
  misc_feature 1..25: note = Synthetic Construct
  source 1..25: mol_type = other DNA
cccatacaactccgagccctagttt

SEQ ID NO: 39550 - DNA, 21 bp, synthetic construct
  misc_feature 1..21: note = Synthetic Construct
  source 1..21: mol_type = other DNA
gcctccaaaggcaaagactga

SEQ ID NO: 39551 - DNA, 25 bp, synthetic construct
  misc_feature 1..25: note = Synthetic Construct
  source 1..25: mol_type = other DNA
gaagtcttgcaaaaagggtcttcat

SEQ ID NO: 39552 - DNA, 20 bp, synthetic construct
  misc_feature 1..20: note = Synthetic Construct
  source 1..20: mol_type = other DNA
cacctttgcaccgaggctta

SEQ ID NO: 39553 - DNA, 22 bp, synthetic construct
  misc_feature 1..22: note = Synthetic Construct
  source 1..22: mol_type = other DNA
gctgcctgaaagcctggatctt

SEQ ID NO: 39554 - DNA, 20 bp, synthetic construct
  misc_feature 1..20: note = Synthetic Construct
  source 1..20: mol_type = other DNA
gcacaccgtgcaggttgata

SEQ ID NO: 39555 - DNA, 20 bp, synthetic construct
  misc_feature 1..20: note = Synthetic Construct
  source 1..20: mol_type = other DNA
cagcaaccagccagaagtgt

SEQ ID NO: 39556 - DNA, 22 bp, synthetic construct
  misc_feature 1..22: note = Synthetic Construct
  source 1..22: mol_type = other DNA
gcctgagagtcggcatttggtt

SEQ ID NO: 39557 - DNA, 24 bp, synthetic construct
  misc_feature 1..24: note = Synthetic Construct
  source 1..24: mol_type = other DNA
tttgccatctttgcagaacctatg

SEQ ID NO: 39558 - DNA, 24 bp, synthetic construct
  misc_feature 1..24: note = Synthetic Construct
  source 1..24: mol_type = other DNA
ggcaaaaggtgaaaggatcagaga

SEQ ID NO: 39559 - DNA, 24 bp, synthetic construct
  misc_feature 1..24: note = Synthetic Construct
  source 1..24: mol_type = other DNA
gctgggaccgaaactgagttatgt

SEQ ID NO: 39560 - DNA, 21 bp, synthetic construct
  misc_feature 1..21: note = Synthetic Construct
  source 1..21: mol_type = other DNA
tgtgaaaggagggcacctgta

SEQ ID NO: 39561 - DNA, 20 bp, synthetic construct
  misc_feature 1..20: note = Synthetic Construct
  source 1..20: mol_type = other DNA
ggctgggagtggcaaaaaca

SEQ ID NO: 39562 - DNA, 23 bp, synthetic construct
  misc_feature 1..23: note = Synthetic Construct
  source 1..23: mol_type = other DNA
ccagagggtctgagttctactgt

SEQ ID NO: 39563 - DNA, 23 bp, synthetic construct
  misc_feature 1..23: note = Synthetic Construct
  source 1..23: mol_type = other DNA
gagccttcaagttgttgggttga

SEQ ID NO: 39564 - DNA, 23 bp, synthetic construct
  misc_feature 1..23: note = Synthetic Construct
  source 1..23: mol_type = other DNA
gaaagttttggtgtggcttggtt

SEQ ID NO: 39565 - DNA, 22 bp, synthetic construct
  misc_feature 1..22: note = Synthetic Construct
  source 1..22: mol_type = other DNA
cgagccaaccatgggctaagaa

SEQ ID NO: 39566 - DNA, 22 bp, synthetic construct
  misc_feature 1..22: note = Synthetic Construct
  source 1..22: mol_type = other DNA
ggcagtgaaaactgctgctgta

SEQ ID NO: 39567 - DNA, 21 bp, synthetic construct
  misc_feature 1..21: note = Synthetic Construct
  source 1..21: mol_type = other DNA
ggggtccccagcaatctaact

SEQ ID NO: 39568 - DNA, 23 bp, synthetic construct
  misc_feature 1..23: note = Synthetic Construct
  source 1..23: mol_type = other DNA
cctctctgtgtgagccgtgtaag

SEQ ID NO: 39569 - DNA, 22 bp, synthetic construct
  misc_feature 1..22: note = Synthetic Construct
  source 1..22: mol_type = other DNA
gacagaccttgtggggcttaac

SEQ ID NO: 39570 - DNA, 22 bp, synthetic construct
  misc_feature 1..22: note = Synthetic Construct
  source 1..22: mol_type = other DNA
aggaatggactggaaccagaga

SEQ ID NO: 39571 - DNA, 22 bp, synthetic construct
  misc_feature 1..22: note = Synthetic Construct
  source 1..22: mol_type = other DNA
ggcatggtttcatctggtcagt

SEQ ID NO: 39572 - DNA, 22 bp, synthetic construct
  misc_feature 1..22: note = Synthetic Construct
  source 1..22: mol_type = other DNA
ggccaaggactggtatgtgtct

SEQ ID NO: 39573 - DNA, 21 bp, synthetic construct
  misc_feature 1..21: note = Synthetic Construct
  source 1..21: mol_type = other DNA
ccatgcttcctcctgccacta

SEQ ID NO: 39574 - DNA, 22 bp, synthetic construct
  misc_feature 1..22: note = Synthetic Construct
  source 1..22: mol_type = other DNA
gggtctcggctgacaagatgta

SEQ ID NO: 39575 - DNA, 24 bp, synthetic construct
  misc_feature 1..24: note = Synthetic Construct
  source 1..24: mol_type = other DNA
ggagagtacagcaagggagtctga

SEQ ID NO: 39576 - DNA, 20 bp, synthetic construct
  misc_feature 1..20: note = Synthetic Construct
  source 1..20: mol_type = other DNA
tacccctgctccctctggtt

SEQ ID NO: 39577 - DNA, 22 bp, synthetic construct
  misc_feature 1..22: note = Synthetic Construct
  source 1..22: mol_type = other DNA
gtagtttgagaccagcctgctt

SEQ ID NO: 39578 - DNA, 23 bp, synthetic construct
  misc_feature 1..23: note = Synthetic Construct
  source 1..23: mol_type = other DNA
tgactctggcctattctccaaca

SEQ ID NO: 39579 - DNA, 24 bp, synthetic construct
  misc_feature 1..24: note = Synthetic Construct
  source 1..24: mol_type = other DNA
ccaagatttcccaccagctacaca

SEQ ID NO: 39580 - DNA, 24 bp, synthetic construct
  misc_feature 1..24: note = Synthetic Construct
  source 1..24: mol_type = other DNA
ggtggttttctctcagcagctctt

SEQ ID NO: 39581 - DNA, 23 bp, synthetic construct
  misc_feature 1..23: note = Synthetic Construct
  source 1..23: mol_type = other DNA
caccaacgacagagcagaaaatc

SEQ ID NO: 39582 - DNA, 24 bp, synthetic construct
  misc_feature 1..24: note = Synthetic Construct
  source 1..24: mol_type = other DNA
cagcatcctccaaggtttcagcta

SEQ ID NO: 39583 - DNA, 23 bp, synthetic construct
  misc_feature 1..23: note = Synthetic Construct
  source 1..23: mol_type = other DNA
gctcctatgggaaacagggaatg

SEQ ID NO: 39584 - DNA, 24 bp, synthetic construct
  misc_feature 1..24: note = Synthetic Construct
  source 1..24: mol_type = other DNA
ccaaccagaagctaaatggcaagt

SEQ ID NO: 39585 - DNA, 22 bp, synthetic construct
  misc_feature 1..22: note = Synthetic Construct
  source 1..22: mol_type = other DNA
cccaaacacactggggaagagt

SEQ ID NO: 39586 - DNA, 27 bp, synthetic construct
  misc_feature 1..27: note = Synthetic Construct
  source 1..27: mol_type = other DNA
gggattaagatgggtgaagctgggaat

SEQ ID NO: 39587 - DNA, 20 bp, synthetic construct
  misc_feature 1..20: note = Synthetic Construct
  source 1..20: mol_type = other DNA
accactgagtcccgtcttgt

SEQ ID NO: 39588 - DNA, 25 bp, synthetic construct
  misc_feature 1..25: note = Synthetic Construct
  source 1..25: mol_type = other DNA
ccagatttaccaacatggagagaca

SEQ ID NO: 39589 - DNA, 20 bp, synthetic construct
  misc_feature 1..20: note = Synthetic Construct
  source 1..20: mol_type = other DNA
atccctgccaccagttgtgt

SEQ ID NO: 39590 - DNA, 25 bp, synthetic construct
  misc_feature 1..25: note = Synthetic Construct
  source 1..25: mol_type = other DNA
gttcctcaaggggaacttgaactac

SEQ ID NO: 39591 - DNA, 25 bp, synthetic construct
  misc_feature 1..25: note = Synthetic Construct
  source 1..25: mol_type = other DNA
ggaaggtcacaagacatcagccata

SEQ ID NO: 39592 - DNA, 26 bp, synthetic construct
  misc_feature 1..26: note = Synthetic Construct
  source 1..26: mol_type = other DNA
gtcctccaaatctgtccacttcatct

SEQ ID NO: 39593 - DNA, 23 bp, synthetic construct
  misc_feature 1..23: note = Synthetic Construct
  source 1..23: mol_type = other DNA
gcagaccaggatgggaccagata

SEQ ID NO: 39594 - DNA, 24 bp, synthetic construct
  misc_feature 1..24: note = Synthetic Construct
  source 1..24: mol_type = other DNA
gattatgctgaaaactgcccttgt

SEQ ID NO: 39595 - DNA, 21 bp, synthetic construct
  misc_feature 1..21: note = Synthetic Construct
  source 1..21: mol_type = other DNA
accagtgtgtccctggactgt

SEQ ID NO: 39596 - DNA, 25 bp, synthetic construct
  misc_feature 1..25: note = Synthetic Construct
  source 1..25: mol_type = other DNA
caacaatgggctaacctttctcttc

SEQ ID NO: 39597 - DNA, 21 bp, synthetic construct
  misc_feature 1..21: note = Synthetic Construct
  source 1..21: mol_type = other DNA
tggctcctctgctccttcctt

SEQ ID NO: 39598 - DNA, 21 bp, synthetic construct
  misc_feature 1..21: note = Synthetic Construct
  source 1..21: mol_type = other DNA
tggggtttaggggaggagtga

SEQ ID NO: 39599 - DNA, 27 bp, synthetic construct
  misc_feature 1..27: note = Synthetic Construct
  source 1..27: mol_type = other DNA
gcatatacggtaaaccttagtccaaac

SEQ ID NO: 39600 - DNA, 22 bp, synthetic construct
  misc_feature 1..22: note = Synthetic Construct
  source 1..22: mol_type = other DNA
cacacaggctttcccctcaatc

SEQ ID NO: 39601 - DNA, 22 bp, synthetic construct
  misc_feature 1..22: note = Synthetic Construct
  source 1..22: mol_type = other DNA
gctgcttcttcccctgaaccaa

SEQ ID NO: 39602 - DNA, 27 bp, synthetic construct
  misc_feature 1..27: note = Synthetic Construct
  source 1..27: mol_type = other DNA
cagtgttttcaataccacccaatgaag

SEQ ID NO: 39603 - DNA, 22 bp, synthetic construct
  misc_feature 1..22: note = Synthetic Construct
  source 1..22: mol_type = other DNA
gtggctttgttctgacgtgctt

SEQ ID NO: 39604 - DNA, 28 bp, synthetic construct
  misc_feature 1..28: note = Synthetic Construct
  source 1..28: mol_type = other DNA
gagcattagtgttagagggtatcacaca

SEQ ID NO: 39605 - DNA, 22 bp, synthetic construct
  misc_feature 1..22: note = Synthetic Construct
  source 1..22: mol_type = other DNA
gtgtaggagtcggggaaagtga

SEQ ID NO: 39606 - DNA, 22 bp, synthetic construct
  misc_feature 1..22: note = Synthetic Construct
  source 1..22: mol_type = other DNA
cccaggtaggttaggctccaat

SEQ ID NO: 39607 - DNA, 25 bp, synthetic construct
  misc_feature 1..25: note = Synthetic Construct
  source 1..25: mol_type = other DNA
gccaaatcctctggaatatggtgaa

SEQ ID NO: 39608 - DNA, 24 bp, synthetic construct
  misc_feature 1..24: note = Synthetic Construct
  source 1..24: mol_type = other DNA
cgtgcaagaactagctgtttgtct

SEQ ID NO: 39609 - DNA, 24 bp, synthetic construct
  misc_feature 1..24: note = Synthetic Construct
  source 1..24: mol_type = other DNA
gggagacagcatgtatcgtagttc

SEQ ID NO: 39610 - DNA, 21 bp, synthetic construct
  misc_feature 1..21: note = Synthetic Construct
  source 1..21: mol_type = other DNA
tcccacctgcctttttcaact

SEQ ID NO: 39611 - DNA, 27 bp, synthetic construct
  misc_feature 1..27: note = Synthetic Construct
  source 1..27: mol_type = other DNA
ctggcactgtttacctcttctagatac

SEQ ID NO: 39612 - DNA, 20 bp, synthetic construct
  misc_feature 1..20: note = Synthetic Construct
  source 1..20: mol_type = other DNA
cccaggcaaagtgggtgtct

SEQ ID NO: 39613 - DNA, 20 bp, synthetic construct
  misc_feature 1..20: note = Synthetic Construct
  source 1..20: mol_type = other DNA
ggccagcaaggggtgaagat

SEQ ID NO: 39614 - DNA, 25 bp, synthetic construct
  misc_feature 1..25: note = Synthetic Construct
  source 1..25: mol_type = other DNA
tgaatccaaatcttggggtgagaag

SEQ ID NO: 39615 - DNA, 25 bp, synthetic construct
  misc_feature 1..25: note = Synthetic Construct
  source 1..25: mol_type = other DNA
ctccatgtgtttgctctcaatcttc

SEQ ID NO: 39616 - DNA, 20 bp, synthetic construct
  misc_feature 1..20: note = Synthetic Construct
  source 1..20: mol_type = other DNA
tctacccgtccaaccccaaa

SEQ ID NO: 39617 - DNA, 30 bp, synthetic construct
  misc_feature 1..30: note = Synthetic Construct
  source 1..30: mol_type = other DNA
cctcatttatcaactgcattctgtctcaag

SEQ ID NO: 39618 - DNA, 26 bp, synthetic construct
  misc_feature 1..26: note = Synthetic Construct
  source 1..26: mol_type = other DNA
cctacttctctcccttagtgggtact

SEQ ID NO: 39619 - DNA, 21 bp, synthetic construct
  misc_feature 1..21: note = Synthetic Construct
  source 1..21: mol_type = other DNA
caggtgtgagccactgtttct

SEQ ID NO: 39620 - DNA, 23 bp, synthetic construct
  misc_feature 1..23: note = Synthetic Construct
  source 1..23: mol_type = other DNA
ccccacatgtgagtcagtagttc

SEQ ID NO: 39621 - DNA, 22 bp, synthetic construct
  misc_feature 1..22: note = Synthetic Construct
  source 1..22: mol_type = other DNA
tgcataaggccactttgagtga

SEQ ID NO: 39622 - DNA, 25 bp, synthetic construct
  misc_feature 1..25: note = Synthetic Construct
  source 1..25: mol_type = other DNA
gcccagttttctcataccacctaag

SEQ ID NO: 39623 - DNA, 24 bp, synthetic construct
  misc_feature 1..24: note = Synthetic Construct
  source 1..24: mol_type = other DNA
gctgtccagctttccacattctgt

SEQ ID NO: 39624 - DNA, 22 bp, synthetic construct
  misc_feature 1..22: note = Synthetic Construct
  source 1..22: mol_type = other DNA
ggcctgagtggatgcaaagcta

SEQ ID NO: 39625 - DNA, 20 bp, synthetic construct
  misc_feature 1..20: note = Synthetic Construct
  source 1..20: mol_type = other DNA
ttccctagcaccgtgagtct

SEQ ID NO: 39626 - DNA, 20 bp, synthetic construct
  misc_feature 1..20: note = Synthetic Construct
  source 1..20: mol_type = other DNA
gccttggcctgtgatgaaca

SEQ ID NO: 39627 - DNA, 23 bp, synthetic construct
  misc_feature 1..23: note = Synthetic Construct
  source 1..23: mol_type = other DNA
ggttctgggcatagagacttcaa

SEQ ID NO: 39628 - DNA, 24 bp, synthetic construct
  misc_feature 1..24: note = Synthetic Construct
  source 1..24: mol_type = other DNA
cccaggaaccaaggttttgcaact

SEQ ID NO: 39629 - DNA, 21 bp, synthetic construct
  misc_feature 1..21: note = Synthetic Construct
  source 1..21: mol_type = other DNA
gccctccctcaactccaatca

SEQ ID NO: 39630 - DNA, 21 bp, synthetic construct
  misc_feature 1..21: note = Synthetic Construct
  source 1..21: mol_type = other DNA
ccagagctgccactgtaatca

SEQ ID NO: 39631 - DNA, 25 bp, synthetic construct
  misc_feature 1..25: note = Synthetic Construct
  source 1..25: mol_type = other DNA
gtgaggtttgcttcttaagcacatt

SEQ ID NO: 39632 - DNA, 27 bp, synthetic construct
  misc_feature 1..27: note = Synthetic Construct
  source 1..27: mol_type = other DNA
ctggctcagtaggtaaaagaagggatt

SEQ ID NO: 39633 - DNA, 23 bp, synthetic construct
  misc_feature 1..23: note = Synthetic Construct
  source 1..23: mol_type = other DNA
acacagaagcttttgcagtgttg

SEQ ID NO: 39634 - DNA, 22 bp, synthetic construct
  misc_feature 1..22: note = Synthetic Construct
  source 1..22: mol_type = other DNA
gctctgtgtcctgggagttgat

SEQ ID NO: 39635 - DNA, 20 bp, synthetic construct
  misc_feature 1..20: note = Synthetic Construct
  source 1..20: mol_type = other DNA
agcaagaaccccaggcagtt

SEQ ID NO: 39636 - DNA, 21 bp, synthetic construct
  misc_feature 1..21: note = Synthetic Construct
  source 1..21: mol_type = other DNA
gatgtctgctgttgggcaatg

SEQ ID NO: 39637 - DNA, 19 bp, synthetic construct
  misc_feature 1..19: note = Synthetic Construct
  source 1..19: mol_type = other DNA
ggtgtgcgctaccacaact

SEQ ID NO: 39638 - DNA, 23 bp, synthetic construct
  misc_feature 1..23: note = Synthetic Construct
  source 1..23: mol_type = other DNA
gtgggtctctttgggagcataag

SEQ ID NO: 39639 - DNA, 22 bp, synthetic construct
  misc_feature 1..22: note = Synthetic Construct
  source 1..22: mol_type = other DNA
ggcagctcaatgggtgtgattc

SEQ ID NO: 39640 - DNA, 23 bp, synthetic construct
  misc_feature 1..23: note = Synthetic Construct
  source 1..23: mol_type = other DNA
gggcaggttacaaggagtgtctt

SEQ ID NO: 39641 - DNA, 20 bp, synthetic construct
  misc_feature 1..20: note = Synthetic Construct
  source 1..20: mol_type = other DNA
tgcccaccagtaagcagaga

SEQ ID NO: 39642 - DNA, 21 bp, synthetic construct
  misc_feature 1..21: note = Synthetic Construct
  source 1..21: mol_type = other DNA
gggttgcctctcttccctgat

SEQ ID NO: 39643 - DNA, 22 bp, synthetic construct
  misc_feature 1..22: note = Synthetic Construct
  source 1..22: mol_type = other DNA
tccaggaccagcatcagacact

SEQ ID NO: 39644 - DNA, 20 bp, synthetic construct
  misc_feature 1..20: note = Synthetic Construct
  source 1..20: mol_type = other DNA
tgtgctgtcccttcctccat

SEQ ID NO: 39645 - DNA, 29 bp, synthetic construct
  misc_feature 1..29: note = Synthetic Construct
  source 1..29: mol_type = other DNA
ggatgaactgagttgaaaggagtttgtgt

SEQ ID NO: 39646 - DNA, 21 bp, synthetic construct
  misc_feature 1..21: note = Synthetic Construct
  source 1..21: mol_type = other DNA
gggagagctgtgtggatgctt

SEQ ID NO: 39647 - DNA, 22 bp, synthetic construct
  misc_feature 1..22: note = Synthetic Construct
  source 1..22: mol_type = other DNA
tctcccatttgccacagagttc

SEQ ID NO: 39648 - DNA, 22 bp, synthetic construct
  misc_feature 1..22: note = Synthetic Construct
  source 1..22: mol_type = other DNA
ccacaggaactgcatgatcgta

SEQ ID NO: 39649 - DNA, 24 bp, synthetic construct
  misc_feature 1..24: note = Synthetic Construct
  source 1..24: mol_type = other DNA
cagctggttgctcagaatccaaac

SEQ ID NO: 39650 - DNA, 22 bp, synthetic construct
  misc_feature 1..22: note = Synthetic Construct
  source 1..22: mol_type = other DNA
gtctgctgactgactgcctaac

SEQ ID NO: 39651 - DNA, 22 bp, synthetic construct
  misc_feature 1..22: note = Synthetic Construct
  source 1..22: mol_type = other DNA
aatggagacggggctgacttac

SEQ ID NO: 39652 - DNA, 22 bp, synthetic construct
  misc_feature 1..22: note = Synthetic Construct
  source 1..22: mol_type = other DNA
ctttccaggagccagggactaa

SEQ ID NO: 39653 - DNA, 20 bp, synthetic construct
  misc_feature 1..20: note = Synthetic Construct
  source 1..20: mol_type = other DNA
agtaacggggagccaggatt

SEQ ID NO: 39654 - DNA, 21 bp, synthetic construct
  misc_feature 1..21: note = Synthetic Construct
  source 1..21: mol_type = other DNA
ccaagtcgctgcaaacgctaa

SEQ ID NO: 39655 - DNA, 21 bp, synthetic construct
  misc_feature 1..21: note = Synthetic Construct
  source 1..21: mol_type = other DNA
gtgaaaagcacccaggcaact

SEQ ID NO: 39656 - DNA, 24 bp, synthetic construct
  misc_feature 1..24: note = Synthetic Construct
  source 1..24: mol_type = other DNA
ctgggtggttccaacattttgatg

SEQ ID NO: 39657 - DNA, 21 bp, synthetic construct
  misc_feature 1..21: note = Synthetic Construct
  source 1..21: mol_type = other DNA
cttgccaaacgaggtgctaag

SEQ ID NO: 39658 - DNA, 24 bp, synthetic construct
  misc_feature 1..24: note = Synthetic Construct
  source 1..24: mol_type = other DNA
catgatcccatcccagaattgaga

SEQ ID NO: 39659 - DNA, 21 bp, synthetic construct
  misc_feature 1..21: note = Synthetic Construct
  source 1..21: mol_type = other DNA
cctgttttggcccatgcctat

SEQ ID NO: 39660 - DNA, 19 bp, synthetic construct
  misc_feature 1..19: note = Synthetic Construct
  source 1..19: mol_type = other DNA
ccagcccacaaaccacaca

SEQ ID NO: 39661 - DNA, 23 bp, synthetic construct
  misc_feature 1..23: note = Synthetic Construct
  source 1..23: mol_type = other DNA
gctgagtagaaacccagtgaaca

SEQ ID NO: 39662 - DNA, 23 bp, synthetic construct
  misc_feature 1..23: note = Synthetic Construct
  source 1..23: mol_type = other DNA
accttcatcgagttccatggttt

SEQ ID NO: 39663 - DNA, 24 bp, synthetic construct
  misc_feature 1..24: note = Synthetic Construct
  source 1..24: mol_type = other DNA
ctgcaaacagttgcctttgtggtt

SEQ ID NO: 39664 - DNA, 20 bp, synthetic construct
  misc_feature 1..20: note = Synthetic Construct
  source 1..20: mol_type = other DNA
agcagccaccgattcctttg

SEQ ID NO: 39665 - DNA, 22 bp, synthetic construct
  misc_feature 1..22: note = Synthetic Construct
  source 1..22: mol_type = other DNA
gtcggacagagttgcctgtttg

SEQ ID NO: 39666 - DNA, 22 bp, synthetic construct
  misc_feature 1..22: note = Synthetic Construct
  source 1..22: mol_type = other DNA
cctcaccaggaaagtgccatta

SEQ ID NO: 39667 - DNA, 24 bp, synthetic construct
  misc_feature 1..24: note = Synthetic Construct
  source 1..24: mol_type = other DNA
ggaactctgcaggtgaacagacaa

SEQ ID NO: 39668 - DNA, 19 bp, synthetic construct
  misc_feature 1..19: note = Synthetic Construct
  source 1..19: mol_type = other DNA
gcatggggaggagctgaca

SEQ ID NO: 39669 - DNA, 24 bp, synthetic construct
  misc_feature 1..24: note = Synthetic Construct
  source 1..24: mol_type = other DNA
gtgtatggtaaacgcttcctcctt

SEQ ID NO: 39670 - DNA, 25 bp, synthetic construct
  misc_feature 1..25: note = Synthetic Construct
  source 1..25: mol_type = other DNA
ggaagacctacaccactgtcacctt

SEQ ID NO: 39671 - DNA, 21 bp, synthetic construct
  misc_feature 1..21: note = Synthetic Construct
  source 1..21: mol_type = other DNA
ggtcagaaaggcagagcactt

SEQ ID NO: 39672 - DNA, 22 bp, synthetic construct
  misc_feature 1..22: note = Synthetic Construct
  source 1..22: mol_type = other DNA
agataatccctggggcctcttc

SEQ ID NO: 39673 - DNA, 26 bp, synthetic construct
  misc_feature 1..26: note = Synthetic Construct
  source 1..26: mol_type = other DNA
atctaccaagtgtactggatggattc

SEQ ID NO: 39674 - DNA, 23 bp, synthetic construct
  misc_feature 1..23: note = Synthetic Construct
  source 1..23: mol_type = other DNA
ggacaaagatgggcagctcaaac

SEQ ID NO: 39675 - DNA, 23 bp, synthetic construct
  misc_feature 1..23: note = Synthetic Construct
  source 1..23: mol_type = other DNA
gtctctctgcctcactcctaaca

SEQ ID NO: 39676 - DNA, 22 bp, synthetic construct
  misc_feature 1..22: note = Synthetic Construct
  source 1..22: mol_type = other DNA
cctagtggtccaagcccaatca

SEQ ID NO: 39677 - DNA, 27 bp, synthetic construct
  misc_feature 1..27: note = Synthetic Construct
  source 1..27: mol_type = other DNA
gctgtttttagatgggaacggaagcat

SEQ ID NO: 39678 - DNA, 20 bp, synthetic construct
  misc_feature 1..20: note = Synthetic Construct
  source 1..20: mol_type = other DNA
accacgatcaggctctgctt

SEQ ID NO: 39679 - DNA, 21 bp, synthetic construct
  misc_feature 1..21: note = Synthetic Construct
  source 1..21: mol_type = other DNA
aggcaagcactggattcaaca

SEQ ID NO: 39680 - DNA, 23 bp, synthetic construct
  misc_feature 1..23: note = Synthetic Construct
  source 1..23: mol_type = other DNA
ccctcctgggctctgaaactaac

SEQ ID NO: 39681 - DNA, 21 bp, synthetic construct
  misc_feature 1..21: note = Synthetic Construct
  source 1..21: mol_type = other DNA
aacctggggtgtggacagaga

SEQ ID NO: 39682 - DNA, 23 bp, synthetic construct
  misc_feature 1..23: note = Synthetic Construct
  source 1..23: mol_type = other DNA
caccagagtgcattgtcagatgt

SEQ ID NO: 39683 - DNA, 23 bp, synthetic construct
  misc_feature 1..23: note = Synthetic Construct
  source 1..23: mol_type = other DNA
tggttaggaaccaaagccttcat

SEQ ID NO: 39684 - DNA, 22 bp, synthetic construct
  misc_feature 1..22: note = Synthetic Construct
  source 1..22: mol_type = other DNA
cacatgtgtgcttaggggtagt

SEQ ID NO: 39685 - DNA, 22 bp, synthetic construct
  misc_feature 1..22: note = Synthetic Construct
  source 1..22: mol_type = other DNA
gcccctccagacttttggaact

SEQ ID NO: 39686 - DNA, 27 bp, synthetic construct
  misc_feature 1..27: note = Synthetic Construct
  source 1..27: mol_type = other DNA
ggttacatttcctcctccatttacagt

SEQ ID NO: 39687 - DNA, 23 bp, synthetic construct
  misc_feature 1..23: note = Synthetic Construct
  source 1..23: mol_type = other DNA
cttgcattccaggaaacccaatg

SEQ ID NO: 39688 - DNA, 23 bp, synthetic construct
  misc_feature 1..23: note = Synthetic Construct
  source 1..23: mol_type = other DNA
ggaagcctcgccacaagaataag

SEQ ID NO: 39689 - DNA, 20 bp, synthetic construct
  misc_feature 1..20: note = Synthetic Construct
  source 1..20: mol_type = other DNA
aggctccccaccttggattt

SEQ ID NO: 39690 - DNA, 25 bp, synthetic construct
  misc_feature 1..25: note = Synthetic Construct
  source 1..25: mol_type = other DNA
ggcccagaacattgggagtggaata

SEQ ID NO: 39691 - DNA, 24 bp, synthetic construct
  misc_feature 1..24: note = Synthetic Construct
  source 1..24: mol_type = other DNA
ggaagcaacactgatactgagaga

SEQ ID NO: 39692 - DNA, 21 bp, synthetic construct
  misc_feature 1..21: note = Synthetic Construct
  source 1..21: mol_type = other DNA
gcagctgcgaataaagctgaa

SEQ ID NO: 39693 - DNA, 19 bp, synthetic construct
  misc_feature 1..19: note = Synthetic Construct
  source 1..19: mol_type = other DNA
ttgctggagtgctgcttca

SEQ ID NO: 39694 - DNA, 20 bp, synthetic construct
  misc_feature 1..20: note = Synthetic Construct
  source 1..20: mol_type = other DNA
agtcacagcccactggaaac

SEQ ID NO: 39695 - DNA, 22 bp, synthetic construct
  misc_feature 1..22: note = Synthetic Construct
  source 1..22: mol_type = other DNA
cagagctgtttctgccatggat

SEQ ID NO: 39696 - DNA, 23 bp, synthetic construct
  misc_feature 1..23: note = Synthetic Construct
  source 1..23: mol_type = other DNA
tgcaagttcacgtgtcttcatgt

SEQ ID NO: 39697 - DNA, 22 bp, synthetic construct
  misc_feature 1..22: note = Synthetic Construct
  source 1..22: mol_type = other DNA
ggttcccggagttcctgtttgt

SEQ ID NO: 39698 - DNA, 18 bp, synthetic construct
  misc_feature 1..18: note = Synthetic Construct
  source 1..18: mol_type = other DNA
tccctcaccagcctgcat

SEQ ID NO: 39699 - DNA, 23 bp, synthetic construct
  misc_feature 1..23: note = Synthetic Construct
  source 1..23: mol_type = other DNA
tcacaccttctgaaacccacatt

SEQ ID NO: 39700 - DNA, 30 bp, synthetic construct
  misc_feature 1..30: note = Synthetic Construct
  source 1..30: mol_type = other DNA
cgaggacttagaactgtagcttaaaagtag

SEQ ID NO: 39701 - DNA, 24 bp, synthetic construct
  misc_feature 1..24: note = Synthetic Construct
  source 1..24: mol_type = other DNA
ggacactacagagatagccctctt

SEQ ID NO: 39702 - DNA, 24 bp, synthetic construct
  misc_feature 1..24: note = Synthetic Construct
  source 1..24: mol_type = other DNA
tgacttgtcttctgcaaagctcta

SEQ ID NO: 39703 - DNA, 24 bp, synthetic construct
  misc_feature 1..24: note = Synthetic Construct
  source 1..24: mol_type = other DNA
gagagtggcactgcaatatcatca

SEQ ID NO: 39704 - DNA, 18 bp, synthetic construct
  misc_feature 1..18: note = Synthetic Construct
  source 1..18: mol_type = other DNA
agggccttgcacgcacat

SEQ ID NO: 39705 - DNA, 23 bp, synthetic construct
  misc_feature 1..23: note = Synthetic Construct
  source 1..23: mol_type = other DNA
ctggagaaggaagccgatgttag

SEQ ID NO: 39706 - DNA, 23 bp, synthetic construct
  misc_feature 1..23: note = Synthetic Construct
  source 1..23: mol_type = other DNA
ggtgtcttgccttgtttgggtaa

SEQ ID NO: 39707 - DNA, 25 bp, synthetic construct
  misc_feature 1..25: note = Synthetic Construct
  source 1..25: mol_type = other DNA
ccttgaaccttgtcatgcctaaaac

SEQ ID NO: 39708 - DNA, 22 bp, synthetic construct
  misc_feature 1..22: note = Synthetic Construct
  source 1..22: mol_type = other DNA
tgtaccacacgtcaagcacttt

SEQ ID NO: 39709 - DNA, 20 bp, synthetic construct
  misc_feature 1..20: note = Synthetic Construct
  source 1..20: mol_type = other DNA
tcaaagctgcctgggagatg

SEQ ID NO: 39710 - DNA, 20 bp, synthetic construct
  misc_feature 1..20: note = Synthetic Construct
  source 1..20: mol_type = other DNA
ggaaccgggctggatgaaga

SEQ ID NO: 39711 - DNA, 24 bp, synthetic construct
  misc_feature 1..24: note = Synthetic Construct
  source 1..24: mol_type = other DNA
cctgcatcaccaagtccattctca

SEQ ID NO: 39712 - DNA, 23 bp, synthetic construct
  misc_feature 1..23: note = Synthetic Construct
  source 1..23: mol_type = other DNA
tcatggttgccaaagaacctact

SEQ ID NO: 39713 - DNA, 20 bp, synthetic construct
  misc_feature 1..20: note = Synthetic Construct
  source 1..20: mol_type = other DNA
caccatggctatggcacaga

SEQ ID NO: 39714 - DNA, 30 bp, synthetic construct
  misc_feature 1..30: note = Synthetic Construct
  source 1..30: mol_type = other DNA
cacaattatccctattatcgcccacaaaga

SEQ ID NO: 39715 - DNA, 24 bp, synthetic construct
  misc_feature 1..24: note = Synthetic Construct
  source 1..24: mol_type = other DNA
gctggttcacttctctcccaggta

SEQ ID NO: 39716 - DNA, 24 bp, synthetic construct
  misc_feature 1..24: note = Synthetic Construct
  source 1..24: mol_type = other DNA
gaagaggctcatttcccttgtttg

SEQ ID NO: 39717 - DNA, 23 bp, synthetic construct
  misc_feature 1..23: note = Synthetic Construct
  source 1..23: mol_type = other DNA
gagtctggggtgacagagtctta

SEQ ID NO: 39718 - DNA, 28 bp, synthetic construct
  misc_feature 1..28: note = Synthetic Construct
  source 1..28: mol_type = other DNA
cctccagtgaatttaccttgccagtttc

SEQ ID NO: 39719 - DNA, 23 bp, synthetic construct
  misc_feature 1..23: note = Synthetic Construct
  source 1..23: mol_type = other DNA
gatggctggtggagtaatcaagt

SEQ ID NO: 39720 - DNA, 22 bp, synthetic construct
  misc_feature 1..22: note = Synthetic Construct
  source 1..22: mol_type = other DNA
ttctggctacacgcccctttac

SEQ ID NO: 39721 - DNA, 20 bp, synthetic construct
  misc_feature 1..20: note = Synthetic Construct
  source 1..20: mol_type = other DNA
tgctgtccatggccacattc

SEQ ID NO: 39722 - DNA, 27 bp, synthetic construct
  misc_feature 1..27: note = Synthetic Construct
  source 1..27: mol_type = other DNA
catcagaaaataggtttggggtaggtt

SEQ ID NO: 39723 - DNA, 20 bp, synthetic construct
  misc_feature 1..20: note = Synthetic Construct
  source 1..20: mol_type = other DNA
aggacctgaggcccagaagt

SEQ ID NO: 39724 - DNA, 25 bp, synthetic construct
  misc_feature 1..25: note = Synthetic Construct
  source 1..25: mol_type = other DNA
gctaaacacaaacttccctccaagt

SEQ ID NO: 39725 - DNA, 20 bp, synthetic construct
  misc_feature 1..20: note = Synthetic Construct
  source 1..20: mol_type = other DNA
tcagttgcctggctggtttg

SEQ ID NO: 39726 - DNA, 22 bp, synthetic construct
  misc_feature 1..22: note = Synthetic Construct
  source 1..22: mol_type = other DNA
aatcaggagctgttggtgttgt

SEQ ID NO: 39727 - DNA, 20 bp, synthetic construct
  misc_feature 1..20: note = Synthetic Construct
  source 1..20: mol_type = other DNA
ccacctggaagccaagttga

SEQ ID NO: 39728 - DNA, 22 bp, synthetic construct
  misc_feature 1..22: note = Synthetic Construct
  source 1..22: mol_type = other DNA
tccaaaccctccctgtcctaag

SEQ ID NO: 39729 - DNA, 23 bp, synthetic construct
  misc_feature 1..23: note = Synthetic Construct
  source 1..23: mol_type = other DNA
tggacatggcaaattggatggat

SEQ ID NO: 39730 - DNA, 25 bp, synthetic construct
  misc_feature 1..25: note = Synthetic Construct
  source 1..25: mol_type = other DNA
gcctgtcttttctgtgcaaggttag

SEQ ID NO: 39731 - DNA, 22 bp, synthetic construct
  misc_feature 1..22: note = Synthetic Construct
  source 1..22: mol_type = other DNA
gtcaggagaggccatcagcttt

SEQ ID NO: 39732 - DNA, 20 bp, synthetic construct
  misc_feature 1..20: note = Synthetic Construct
  source 1..20: mol_type = other DNA
tcccacagtgccctggcata

SEQ ID NO: 39733 - DNA, 23 bp, synthetic construct
  misc_feature 1..23: note = Synthetic Construct
  source 1..23: mol_type = other DNA
cttggatcaactttcccgacaac

SEQ ID NO: 39734 - DNA, 23 bp, synthetic construct
  misc_feature 1..23: note = Synthetic Construct
  source 1..23: mol_type = other DNA
tggaccgtaatgacaccagtaac

SEQ ID NO: 39735 - DNA, 21 bp, synthetic construct
  misc_feature 1..21: note = Synthetic Construct
  source 1..21: mol_type = other DNA
ccaccagtcctggacactgat

SEQ ID NO: 39736 - DNA, 27 bp, synthetic construct
  misc_feature 1..27: note = Synthetic Construct
  source 1..27: mol_type = other DNA
ggtgagcttaaattaggaggaggatag

SEQ ID NO: 39737 - DNA, 20 bp, synthetic construct
  misc_feature 1..20: note = Synthetic Construct
  source 1..20: mol_type = other DNA
gttgaccttcaggccacaga

SEQ ID NO: 39738 - DNA, 21 bp, synthetic construct
  misc_feature 1..21: note = Synthetic Construct
  source 1..21: mol_type = other DNA
accctgtgatggggtgctgtt

SEQ ID NO: 39739 - DNA, 20 bp, synthetic construct
  misc_feature 1..20: note = Synthetic Construct
  source 1..20: mol_type = other DNA
agccaaggacaagcgacact

SEQ ID NO: 39740 - DNA, 23 bp, synthetic construct
  misc_feature 1..23: note = Synthetic Construct
  source 1..23: mol_type = other DNA
cctgaatggcattgggcttgact

SEQ ID NO: 39741 - DNA, 23 bp, synthetic construct
  misc_feature 1..23: note = Synthetic Construct
  source 1..23: mol_type = other DNA
gggttcagcattcatggggtaag

SEQ ID NO: 39742 - DNA, 23 bp, synthetic construct
  misc_feature 1..23: note = Synthetic Construct
  source 1..23: mol_type = other DNA
caagctgggatagagggcttttg

SEQ ID NO: 39743 - DNA, 21 bp, synthetic construct
  misc_feature 1..21: note = Synthetic Construct
  source 1..21: mol_type = other DNA
gcaggtgctcttcctgctgtt

SEQ ID NO: 39744 - DNA, 25 bp, synthetic construct
  misc_feature 1..25: note = Synthetic Construct
  source 1..25: mol_type = other DNA
gaatgggcaaagcactggtaatttt

SEQ ID NO: 39745 - DNA, 22 bp, synthetic construct
  misc_feature 1..22: note = Synthetic Construct
  source 1..22: mol_type = other DNA
gcttgagggtctgccaatccat

SEQ ID NO: 39746 - DNA, 24 bp, synthetic construct
  misc_feature 1..24: note = Synthetic Construct
  source 1..24: mol_type = other DNA
gggccttacttggggagaagaagt

SEQ ID NO: 39747 - DNA, 20 bp, synthetic construct
  misc_feature 1..20: note = Synthetic Construct
  source 1..20: mol_type = other DNA
aggtggcagaggatgcattg

SEQ ID NO: 39748 - DNA, 19 bp, synthetic construct
  misc_feature 1..19: note = Synthetic Construct
  source 1..19: mol_type = other DNA
ttctgcctcaccccagctt

SEQ ID NO: 39749 - DNA, 22 bp, synthetic construct
  misc_feature 1..22: note = Synthetic Construct
  source 1..22: mol_type = other DNA
tccccttcactcgaggtactgt

SEQ ID NO: 39750 - DNA, 22 bp, synthetic construct
  misc_feature 1..22: note = Synthetic Construct
  source 1..22: mol_type = other DNA
ccaaccatgcagtgatgctgta

SEQ ID NO: 39751 - DNA, 25 bp, synthetic construct
  misc_feature 1..25: note = Synthetic Construct
  source 1..25: mol_type = other DNA
cccctgcaactatcatccctgtaag

SEQ ID NO: 39752 - DNA, 24 bp, synthetic construct
  misc_feature 1..24: note = Synthetic Construct
  source 1..24: mol_type = other DNA
gcctgcttggagtctctcacaaat

SEQ ID NO: 39753 - DNA, 19 bp, synthetic construct
  misc_feature 1..19: note = Synthetic Construct
  source 1..19: mol_type = other DNA
acgagccaccatgccctta

SEQ ID NO: 39754 - DNA, 24 bp, synthetic construct
  misc_feature 1..24: note = Synthetic Construct
  source 1..24: mol_type = other DNA
ctccatcctgtctggcctaaaatg

SEQ ID NO: 39755 - DNA, 26 bp, synthetic construct
  misc_feature 1..26: note = Synthetic Construct
  source 1..26: mol_type = other DNA
cttctcttcactcaacagaggaacaa

SEQ ID NO: 39756 - DNA, 21 bp, synthetic construct
  misc_feature 1..21: note = Synthetic Construct
  source 1..21: mol_type = other DNA
gtggttggaccgttagcatgt

SEQ ID NO: 39757 - DNA, 22 bp, synthetic construct
  misc_feature 1..22: note = Synthetic Construct
  source 1..22: mol_type = other DNA
gggaaggcttctggagttgatg

SEQ ID NO: 39758 - DNA, 22 bp, synthetic construct
  misc_feature 1..22: note = Synthetic Construct
  source 1..22: mol_type = other DNA
tggagccccatccagatcttag

SEQ ID NO: 39759 - DNA, 21 bp, synthetic construct
  misc_feature 1..21: note = Synthetic Construct
  source 1..21: mol_type = other DNA
gctttgccaggcacatctcaa

SEQ ID NO: 39760 - DNA, 19 bp, synthetic construct
  misc_feature 1..19: note = Synthetic Construct
  source 1..19: mol_type = other DNA
agatggggagggccatcaa

SEQ ID NO: 39761 - DNA, 21 bp, synthetic construct
  misc_feature 1..21: note = Synthetic Construct
  source 1..21: mol_type = other DNA
caggcttggcattgtgacttg

SEQ ID NO: 39762 - DNA, 22 bp, synthetic construct
  misc_feature 1..22: note = Synthetic Construct
  source 1..22: mol_type = other DNA
gccaagtaactcaggcccttgt

SEQ ID NO: 39763 - DNA, 19 bp, synthetic construct
  misc_feature 1..19: note = Synthetic Construct
  source 1..19: mol_type = other DNA
ccttgggagccaggcacat

SEQ ID NO: 39764 - DNA, 21 bp, synthetic construct
  misc_feature 1..21: note = Synthetic Construct
  source 1..21: mol_type = other DNA
taccccactgtgcccctttca

SEQ ID NO: 39765 - DNA, 23 bp, synthetic construct
  misc_feature 1..23: note = Synthetic Construct
  source 1..23: mol_type = other DNA
ggaatcatggcttggcagtttca

SEQ ID NO: 39766 - DNA, 23 bp, synthetic construct
  misc_feature 1..23: note = Synthetic Construct
  source 1..23: mol_type = other DNA
gcccaggcagatctacaggtact

SEQ ID NO: 39767 - DNA, 22 bp, synthetic construct
  misc_feature 1..22: note = Synthetic Construct
  source 1..22: mol_type = other DNA
gcttggttccatggggagtgaa

SEQ ID NO: 39768 - DNA, 22 bp, synthetic construct
  misc_feature 1..22: note = Synthetic Construct
  source 1..22: mol_type = other DNA
ctcagagtctggttccctgaga

SEQ ID NO: 39769 - DNA, 23 bp, synthetic construct
  misc_feature 1..23: note = Synthetic Construct
  source 1..23: mol_type = other DNA
cagacaaggaaacagccctggat

SEQ ID NO: 39770 - DNA, 23 bp, synthetic construct
  misc_feature 1..23: note = Synthetic Construct
  source 1..23: mol_type = other DNA
ccctccctggctagaagttcctt

SEQ ID NO: 39771 - DNA, 27 bp, synthetic construct
  misc_feature 1..27: note = Synthetic Construct
  source 1..27: mol_type = other DNA
gctgttttcaaggctaaaggtaacgat

SEQ ID NO: 39772 - DNA, 21 bp, synthetic construct
  misc_feature 1..21: note = Synthetic Construct
  source 1..21: mol_type = other DNA
cacctgtaccttgggttgctt

SEQ ID NO: 39773 - DNA, 24 bp, synthetic construct
  misc_feature 1..24: note = Synthetic Construct
  source 1..24: mol_type = other DNA
ccagatctagaaccctggtagcat

SEQ ID NO: 39774 - DNA, 20 bp, synthetic construct
  misc_feature 1..20: note = Synthetic Construct
  source 1..20: mol_type = other DNA
actccacaggtgccatccta

SEQ ID NO: 39775 - DNA, 24 bp, synthetic construct
  misc_feature 1..24: note = Synthetic Construct
  source 1..24: mol_type = other DNA
ccttccaaccactttctgccttgt

SEQ ID NO: 39776 - DNA, 25 bp, synthetic construct
  misc_feature 1..25: note = Synthetic Construct
  source 1..25: mol_type = other DNA
ggcaaaagcaaatagggctggacta

SEQ ID NO: 39777 - DNA, 22 bp, synthetic construct
  misc_feature 1..22: note = Synthetic Construct
  source 1..22: mol_type = other DNA
tcctcttcctgcagctgataca

SEQ ID NO: 39778 - DNA, 25 bp, synthetic construct
  misc_feature 1..25: note = Synthetic Construct
  source 1..25: mol_type = other DNA
ggtcattctgcctgtcttagggaat

SEQ ID NO: 39779 - DNA, 20 bp, synthetic construct
  misc_feature 1..20: note = Synthetic Construct
  source 1..20: mol_type = other DNA
tttgggtgggccacggttta

SEQ ID NO: 39780 - DNA, 22 bp, synthetic construct
  misc_feature 1..22: note = Synthetic Construct
  source 1..22: mol_type = other DNA
ctgaagagcctcccaacacaca

SEQ ID NO: 39781 - DNA, 24 bp, synthetic construct
  misc_feature 1..24: note = Synthetic Construct
  source 1..24: mol_type = other DNA
ccgacttgctcatcatgggtgatt

SEQ ID NO: 39782 - DNA, 20 bp, synthetic construct
  misc_feature 1..20: note = Synthetic Construct
  source 1..20: mol_type = other DNA
acacggccaagcacagtcaa

SEQ ID NO: 39783 - DNA, 22 bp, synthetic construct
  misc_feature 1..22: note = Synthetic Construct
  source 1..22: mol_type = other DNA
cccagcagccatttccactgat

SEQ ID NO: 39784 - DNA, 20 bp, synthetic construct
  misc_feature 1..20: note = Synthetic Construct
  source 1..20: mol_type = other DNA
gccaggcaaaccttgtcatc

SEQ ID NO: 39785 - DNA, 25 bp, synthetic construct
  misc_feature 1..25: note = Synthetic Construct
  source 1..25: mol_type = other DNA
gggacattctctggttattgacgaa

SEQ ID NO: 39786 - DNA, 22 bp, synthetic construct
  misc_feature 1..22: note = Synthetic Construct
  source 1..22: mol_type = other DNA
cctagctcctgtgagacacaac

SEQ ID NO: 39787 - DNA, 22 bp, synthetic construct
  misc_feature 1..22: note = Synthetic Construct
  source 1..22: mol_type = other DNA
ggcttcagaggcagtgacagaa

SEQ ID NO: 39788 - DNA, 20 bp, synthetic construct
  misc_feature 1..20: note = Synthetic Construct
  source 1..20: mol_type = other DNA
agtgtgacgagggtgaggaa

SEQ ID NO: 39789 - DNA, 19 bp, synthetic construct
  misc_feature 1..19: note = Synthetic Construct
  source 1..19: mol_type = other DNA
gagggcagaccagggatga

SEQ ID NO: 39790 - DNA, 23 bp, synthetic construct
  misc_feature 1..23: note = Synthetic Construct
  source 1..23: mol_type = other DNA
atttgcatcacctcccttagctt

SEQ ID NO: 39791 - DNA, 25 bp, synthetic construct
  misc_feature 1..25: note = Synthetic Construct
  source 1..25: mol_type = other DNA
cggataaaggctacgaacacaagaa

SEQ ID NO: 39792 - DNA, 25 bp, synthetic construct
  misc_feature 1..25: note = Synthetic Construct
  source 1..25: mol_type = other DNA
ggatactctgacctgctgttagttt

SEQ ID NO: 39793 - DNA, 22 bp, synthetic construct
  misc_feature 1..22: note = Synthetic Construct
  source 1..22: mol_type = other DNA
gctaagtgcgagggctttggaa

SEQ ID NO: 39794 - DNA, 24 bp, synthetic construct
  misc_feature 1..24: note = Synthetic Construct
  source 1..24: mol_type = other DNA
cagcaaaaccaaagtgctgtgcta

SEQ ID NO: 39795 - DNA, 20 bp, synthetic construct
  misc_feature 1..20: note = Synthetic Construct
  source 1..20: mol_type = other DNA
aggcctgagtgccgatctaa

SEQ ID NO: 39796 - DNA, 24 bp, synthetic construct
  misc_feature 1..24: note = Synthetic Construct
  source 1..24: mol_type = other DNA
ctccctcttggctactctttggat

SEQ ID NO: 39797 - DNA, 22 bp, synthetic construct
  misc_feature 1..22: note = Synthetic Construct
  source 1..22: mol_type = other DNA
caccctcttaccagcagcaaca

SEQ ID NO: 39798 - DNA, 25 bp, synthetic construct
  misc_feature 1..25: note = Synthetic Construct
  source 1..25: mol_type = other DNA
actacatccttcagtggcaacatac

SEQ ID NO: 39799 - DNA, 22 bp, synthetic construct
  misc_feature 1..22: note = Synthetic Construct
  source 1..22: mol_type = other DNA
cagagaacaggctcagctgtca

SEQ ID NO: 39800 - DNA, 23 bp, synthetic construct
  misc_feature 1..23: note = Synthetic Construct
  source 1..23: mol_type = other DNA
gatggagagagtgattggcaaga

SEQ ID NO: 39801 - DNA, 26 bp, synthetic construct
  misc_feature 1..26: note = Synthetic Construct
  source 1..26: mol_type = other DNA
gactgattctgccacctatactgaac

SEQ ID NO: 39802 - DNA, 29 bp, synthetic construct
  misc_feature 1..29: note = Synthetic Construct
  source 1..29: mol_type = other DNA
cctggacctttcttaataccaggaacctt

SEQ ID NO: 39803 - DNA, 26 bp, synthetic construct
  misc_feature 1..26: note = Synthetic Construct
  source 1..26: mol_type = other DNA
ctcattgtccacagattgatcaccat

SEQ ID NO: 39804 - DNA, 26 bp, synthetic construct
  misc_feature 1..26: note = Synthetic Construct
  source 1..26: mol_type = other DNA
gaaaggagagataggttagcgttttg

SEQ ID NO: 39805 - DNA, 23 bp, synthetic construct
  misc_feature 1..23: note = Synthetic Construct
  source 1..23: mol_type = other DNA
gggtgtcattttccttgcttgaa

SEQ ID NO: 39806 - DNA, 25 bp, synthetic construct
  misc_feature 1..25: note = Synthetic Construct
  source 1..25: mol_type = other DNA
cagggtaacaggccagagttaatca

SEQ ID NO: 39807 - DNA, 20 bp, synthetic construct
  misc_feature 1..20: note = Synthetic Construct
  source 1..20: mol_type = other DNA
agaacccatgggctggaaga

SEQ ID NO: 39808 - DNA, 22 bp, synthetic construct
  misc_feature 1..22: note = Synthetic Construct
  source 1..22: mol_type = other DNA
gctgtgagcaaggttcctgtgt

SEQ ID NO: 39809 - DNA, 25 bp, synthetic construct
  misc_feature 1..25: note = Synthetic Construct
  source 1..25: mol_type = other DNA
ctgcagtattcacagagcctcaagt

SEQ ID NO: 39810 - DNA, 23 bp, synthetic construct
  misc_feature 1..23: note = Synthetic Construct
  source 1..23: mol_type = other DNA
agaactgtgcctgctagtacatc

SEQ ID NO: 39811 - DNA, 20 bp, synthetic construct
  misc_feature 1..20: note = Synthetic Construct
  source 1..20: mol_type = other DNA
ttcccaaggtgccactgact

SEQ ID NO: 39812 - DNA, 22 bp, synthetic construct
  misc_feature 1..22: note = Synthetic Construct
  source 1..22: mol_type = other DNA
caagggcttttggctcttcttc

SEQ ID NO: 39813 - DNA, 23 bp, synthetic construct
  misc_feature 1..23: note = Synthetic Construct
  source 1..23: mol_type = other DNA
ctgtctcgaagatggtgccttgt

SEQ ID NO: 39814 - DNA, 22 bp, synthetic construct
  misc_feature 1..22: note = Synthetic Construct
  source 1..22: mol_type = other DNA
cctcagtgtgctctctgcttgt

SEQ ID NO: 39815 - DNA, 23 bp, synthetic construct
  misc_feature 1..23: note = Synthetic Construct
  source 1..23: mol_type = other DNA
cctcaaactaccccacaccaagt

SEQ ID NO: 39816 - DNA, 24 bp, synthetic construct
  misc_feature 1..24: note = Synthetic Construct
  source 1..24: mol_type = other DNA
gagctggacttggataggtcagtt

SEQ ID NO: 39817 - DNA, 23 bp, synthetic construct
  misc_feature 1..23: note = Synthetic Construct
  source 1..23: mol_type = other DNA
agctagtttgctcctacgtcttg

SEQ ID NO: 39818 - DNA, 18 bp, synthetic construct
  misc_feature 1..18: note = Synthetic Construct
  source 1..18: mol_type = other DNA
gtggcttgggtgccagtt

SEQ ID NO: 39819 - DNA, 23 bp, synthetic construct
  misc_feature 1..23: note = Synthetic Construct
  source 1..23: mol_type = other DNA
caagaggtgagaaggggtctagt

SEQ ID NO: 39820 - DNA, 25 bp, synthetic construct
  misc_feature 1..25: note = Synthetic Construct
  source 1..25: mol_type = other DNA
agtccatgtatcaccaagctcattc

SEQ ID NO: 39821 - DNA, 19 bp, synthetic construct
  misc_feature 1..19: note = Synthetic Construct
  source 1..19: mol_type = other DNA
acaaggtgggtggccaagt

SEQ ID NO: 39822 - DNA, 20 bp, synthetic construct
  misc_feature 1..20: note = Synthetic Construct
  source 1..20: mol_type = other DNA
ggccttggaccctgaacaaa

SEQ ID NO: 39823 - DNA, 26 bp, synthetic construct
  misc_feature 1..26: note = Synthetic Construct
  source 1..26: mol_type = other DNA
ccctcctaatgtctccctttcctttc

SEQ ID NO: 39824 - DNA, 26 bp, synthetic construct
  misc_feature 1..26: note = Synthetic Construct
  source 1..26: mol_type = other DNA
ggtcactgactttgagatagcaagta

SEQ ID NO: 39825 - DNA, 22 bp, synthetic construct
  misc_feature 1..22: note = Synthetic Construct
  source 1..22: mol_type = other DNA
ccagaagctccagtgtttgaca

SEQ ID NO: 39826 - DNA, 24 bp, synthetic construct
  misc_feature 1..24: note = Synthetic Construct
  source 1..24: mol_type = other DNA
gctgctcctctattagctcctttt

SEQ ID NO: 39827 - DNA, 21 bp, synthetic construct
  misc_feature 1..21: note = Synthetic Construct
  source 1..21: mol_type = other DNA
aaaagaggaagagcggcatga

SEQ ID NO: 39828 - DNA, 23 bp, synthetic construct
  misc_feature 1..23: note = Synthetic Construct
  source 1..23: mol_type = other DNA
cagggatttgccacaaagcaatc

SEQ ID NO: 39829 - DNA, 21 bp, synthetic construct
  misc_feature 1..21: note = Synthetic Construct
  source 1..21: mol_type = other DNA
ctgacatgtggctggcattct

SEQ ID NO: 39830 - DNA, 22 bp, synthetic construct
  misc_feature 1..22: note = Synthetic Construct
  source 1..22: mol_type = other DNA
ggcacagcaatatgcaggtttt

SEQ ID NO: 39831 - DNA, 20 bp, synthetic construct
  misc_feature 1..20: note = Synthetic Construct
  source 1..20: mol_type = other DNA
atcaggctgtgggtctctgt

SEQ ID NO: 39832 - DNA, 26 bp, synthetic construct
  misc_feature 1..26: note = Synthetic Construct
  source 1..26: mol_type = other DNA
ccattttcattcgtgagtgggtcatt

SEQ ID NO: 39833 - DNA, 22 bp, synthetic construct
  misc_feature 1..22: note = Synthetic Construct
  source 1..22: mol_type = other DNA
aactgggactgtcctgacaaag

SEQ ID NO: 39834 - DNA, 21 bp, synthetic construct
  misc_feature 1..21: note = Synthetic Construct
  source 1..21: mol_type = other DNA
gccctgcaggagggaatcaat

SEQ ID NO: 39835 - DNA, 21 bp, synthetic construct
  misc_feature 1..21: note = Synthetic Construct
  source 1..21: mol_type = other DNA
gccagaagcttgctcctcctt

SEQ ID NO: 39836 - DNA, 23 bp, synthetic construct
  misc_feature 1..23: note = Synthetic Construct
  source 1..23: mol_type = other DNA
caacatgtatctctcgggcaaac

SEQ ID NO: 39837 - DNA, 22 bp, synthetic construct
  misc_feature 1..22: note = Synthetic Construct
  source 1..22: mol_type = other DNA
gtaggtcacccacagtttgaca

SEQ ID NO: 39838 - DNA, 20 bp, synthetic construct
  misc_feature 1..20: note = Synthetic Construct
  source 1..20: mol_type = other DNA
atgcccacagggagcctctt

SEQ ID NO: 39839 - DNA, 21 bp, synthetic construct
  misc_feature 1..21: note = Synthetic Construct
  source 1..21: mol_type = other DNA
ttccatagagctggggagtgt

SEQ ID NO: 39840 - DNA, 21 bp, synthetic construct
  misc_feature 1..21: note = Synthetic Construct
  source 1..21: mol_type = other DNA
agccaataaggagtgcgttca

SEQ ID NO: 39841 - DNA, 20 bp, synthetic construct
  misc_feature 1..20: note = Synthetic Construct
  source 1..20: mol_type = other DNA
tgcggacagcagggctaaaa

SEQ ID NO: 39842 - DNA, 24 bp, synthetic construct
  misc_feature 1..24: note = Synthetic Construct
  source 1..24: mol_type = other DNA
gcagttggaaccaaagactggtaa

SEQ ID NO: 39843 - DNA, 21 bp, synthetic construct
  misc_feature 1..21: note = Synthetic Construct
  source 1..21: mol_type = other DNA
ctgtccgacttgggtgaaaca

SEQ ID NO: 39844 - DNA, 22 bp, synthetic construct
  misc_feature 1..22: note = Synthetic Construct
  source 1..22: mol_type = other DNA
cacacaagctcacaggggtttg

SEQ ID NO: 39845 - DNA, 23 bp, synthetic construct
  misc_feature 1..23: note = Synthetic Construct
  source 1..23: mol_type = other DNA
tctctgttcgtggagatcctagt

SEQ ID NO: 39846 - DNA, 22 bp, synthetic construct
  misc_feature 1..22: note = Synthetic Construct
  source 1..22: mol_type = other DNA
ggatgctacccctggaggaaaa

SEQ ID NO: 39847 - DNA, 23 bp, synthetic construct
  misc_feature 1..23: note = Synthetic Construct
  source 1..23: mol_type = other DNA
ggcttcaatcatgacaccagttg

SEQ ID NO: 39848 - DNA, 28 bp, synthetic construct
  misc_feature 1..28: note = Synthetic Construct
  source 1..28: mol_type = other DNA
ctgatagaaaattgagctccaccacttc

SEQ ID NO: 39849 - DNA, 23 bp, synthetic construct
  misc_feature 1..23: note = Synthetic Construct
  source 1..23: mol_type = other DNA
gccaggtatgtgaagaggtcagt

SEQ ID NO: 39850 - DNA, 20 bp, synthetic construct
  misc_feature 1..20: note = Synthetic Construct
  source 1..20: mol_type = other DNA
tcccattccgccactcatct

SEQ ID NO: 39851 - DNA, 26 bp, synthetic construct
  misc_feature 1..26: note = Synthetic Construct
  source 1..26: mol_type = other DNA
gtctcacttacagtggaaatgtcctt

SEQ ID NO: 39852 - DNA, 22 bp, synthetic construct
  misc_feature 1..22: note = Synthetic Construct
  source 1..22: mol_type = other DNA
tccaaaggattcctgggctact

SEQ ID NO: 39853 - DNA, 20 bp, synthetic construct
  misc_feature 1..20: note = Synthetic Construct
  source 1..20: mol_type = other DNA
actggaagccctgccactca

SEQ ID NO: 39854 - DNA, 19 bp, synthetic construct
  misc_feature 1..19: note = Synthetic Construct
  source 1..19: mol_type = other DNA
cccagcaagcctgcactca

SEQ ID NO: 39855 - DNA, 22 bp, synthetic construct
  misc_feature 1..22: note = Synthetic Construct
  source 1..22: mol_type = other DNA
cacccctacgtgttcaatcagt

SEQ ID NO: 39856 - DNA, 27 bp, synthetic construct
  misc_feature 1..27: note = Synthetic Construct
  source 1..27: mol_type = other DNA
ggaaggtaaaggtggagagtgtctact

SEQ ID NO: 39857 - DNA, 23 bp, synthetic construct
  misc_feature 1..23: note = Synthetic Construct
  source 1..23: mol_type = other DNA
gtggttgatgcctctttcctttc

SEQ ID NO: 39858 - DNA, 19 bp, synthetic construct
  misc_feature 1..19: note = Synthetic Construct
  source 1..19: mol_type = other DNA
ggcctgtgcacccctttag

SEQ ID NO: 39859 - DNA, 24 bp, synthetic construct
  misc_feature 1..24: note = Synthetic Construct
  source 1..24: mol_type = other DNA
cgtaataatgccctgatgctctct

SEQ ID NO: 39860 - DNA, 24 bp, synthetic construct
  misc_feature 1..24: note = Synthetic Construct
  source 1..24: mol_type = other DNA
gtgggaaagaagggtgctgtattg

SEQ ID NO: 39861 - DNA, 25 bp, synthetic construct
  misc_feature 1..25: note = Synthetic Construct
  source 1..25: mol_type = other DNA
gtttagtagcttggggttgaagaga

SEQ ID NO: 39862 - DNA, 24 bp, synthetic construct
  misc_feature 1..24: note = Synthetic Construct
  source 1..24: mol_type = other DNA
gggaatttacagtccctcggcata

SEQ ID NO: 39863 - DNA, 20 bp, synthetic construct
  misc_feature 1..20: note = Synthetic Construct
  source 1..20: mol_type = other DNA
accccagtgcctgcaaatgt

SEQ ID NO: 39864 - DNA, 23 bp, synthetic construct
  misc_feature 1..23: note = Synthetic Construct
  source 1..23: mol_type = other DNA
gtcaaaacccaaaatgcgctcaa

SEQ ID NO: 39865 - DNA, 25 bp, synthetic construct
  misc_feature 1..25: note = Synthetic Construct
  source 1..25: mol_type = other DNA
gatgcaatatgaagtgctgtcttga

SEQ ID NO: 39866 - DNA, 23 bp, synthetic construct
  misc_feature 1..23: note = Synthetic Construct
  source 1..23: mol_type = other DNA
tgtggttatggccaatcctttct

SEQ ID NO: 39867 - DNA, 22 bp, synthetic construct
  misc_feature 1..22: note = Synthetic Construct
  source 1..22: mol_type = other DNA
aattgtccgctttggagagcta

SEQ ID NO: 39868 - DNA, 20 bp, synthetic construct
  misc_feature 1..20: note = Synthetic Construct
  source 1..20: mol_type = other DNA
tttgaggccctggcctgctt

SEQ ID NO: 39869 - DNA, 22 bp, synthetic construct
  misc_feature 1..22: note = Synthetic Construct
  source 1..22: mol_type = other DNA
gcaggggaggaacatcaaggta

SEQ ID NO: 39870 - DNA, 23 bp, synthetic construct
  misc_feature 1..23: note = Synthetic Construct
  source 1..23: mol_type = other DNA
gacacgacctctcttgacacttg

SEQ ID NO: 39871 - DNA, 21 bp, synthetic construct
  misc_feature 1..21: note = Synthetic Construct
  source 1..21: mol_type = other DNA
acagatggggtgtaggagcaa

SEQ ID NO: 39872 - DNA, 21 bp, synthetic construct
  misc_feature 1..21: note = Synthetic Construct
  source 1..21: mol_type = other DNA
agtaggcccttctcagcaagt

SEQ ID NO: 39873 - DNA, 22 bp, synthetic construct
  misc_feature 1..22: note = Synthetic Construct
  source 1..22: mol_type = other DNA
ttggccttacccagtgtctaac

SEQ ID NO: 39874 - DNA, 23 bp, synthetic construct
  misc_feature 1..23: note = Synthetic Construct
  source 1..23: mol_type = other DNA
tgtttctttgggaggagcacatt

SEQ ID NO: 39875 - DNA, 21 bp, synthetic construct
  misc_feature 1..21: note = Synthetic Construct
  source 1..21: mol_type = other DNA
actcctcctgcctcccataca

SEQ ID NO: 39876 - DNA, 20 bp, synthetic construct
  misc_feature 1..20: note = Synthetic Construct
  source 1..20: mol_type = other DNA
tccgtcctttgctgctgatg

SEQ ID NO: 39877 - DNA, 25 bp, synthetic construct
  misc_feature 1..25: note = Synthetic Construct
  source 1..25: mol_type = other DNA
aatcccttgtcataccaagaaccaa

SEQ ID NO: 39878 - DNA, 20 bp, synthetic construct
  misc_feature 1..20: note = Synthetic Construct
  source 1..20: mol_type = other DNA
taacgggctggctggcacta

SEQ ID NO: 39879 - DNA, 20 bp, synthetic construct
  misc_feature 1..20: note = Synthetic Construct
  source 1..20: mol_type = other DNA
ttgggtggcatcctgcaatg

SEQ ID NO: 39880 - DNA, 22 bp, synthetic construct
  misc_feature 1..22: note = Synthetic Construct
  source 1..22: mol_type = other DNA
ccacacattgcaccaactcact

SEQ ID NO: 39881 - DNA, 26 bp, synthetic construct
  misc_feature 1..26: note = Synthetic Construct
  source 1..26: mol_type = other DNA
ggtcaacttacctggacgtatagaga

SEQ ID NO: 39882 - DNA, 21 bp, synthetic construct
  misc_feature 1..21: note = Synthetic Construct
  source 1..21: mol_type = other DNA
gctggatgggcttacacactt

SEQ ID NO: 39883 - DNA, 21 bp, synthetic construct
  misc_feature 1..21: note = Synthetic Construct
  source 1..21: mol_type = other DNA
gtgagcatggttggcagtgta

SEQ ID NO: 39884 - DNA, 22 bp, synthetic construct
  misc_feature 1..22: note = Synthetic Construct
  source 1..22: mol_type = other DNA
ggggaggggatttcaggctttt

SEQ ID NO: 39885 - DNA, 23 bp, synthetic construct
  misc_feature 1..23: note = Synthetic Construct
  source 1..23: mol_type = other DNA
gcctgggtttttctgctcacaac

SEQ ID NO: 39886 - DNA, 19 bp, synthetic construct
  misc_feature 1..19: note = Synthetic Construct
  source 1..19: mol_type = other DNA
agctcagcagcagccaaac

SEQ ID NO: 39887 - DNA, 23 bp, synthetic construct
  misc_feature 1..23: note = Synthetic Construct
  source 1..23: mol_type = other DNA
gcgtggccattttcctgaaccta

SEQ ID NO: 39888 - DNA, 24 bp, synthetic construct
  misc_feature 1..24: note = Synthetic Construct
  source 1..24: mol_type = other DNA
gcacagtcttccaactgcctgaag

SEQ ID NO: 39889 - DNA, 24 bp, synthetic construct
  misc_feature 1..24: note = Synthetic Construct
  source 1..24: mol_type = other DNA
tcacctaagtgcaccttactctct

SEQ ID NO: 39890 - DNA, 22 bp, synthetic construct
  misc_feature 1..22: note = Synthetic Construct
  source 1..22: mol_type = other DNA
gccgccctacagattcctaact

SEQ ID NO: 39891 - DNA, 22 bp, synthetic construct
  misc_feature 1..22: note = Synthetic Construct
  source 1..22: mol_type = other DNA
ctaaaactgggttcccgtcaca

SEQ ID NO: 39892 - DNA, 22 bp, synthetic construct
  misc_feature 1..22: note = Synthetic Construct
  source 1..22: mol_type = other DNA
ggtttcaccaccgtgcagttac

SEQ ID NO: 39893 - DNA, 20 bp, synthetic construct
  misc_feature 1..20: note = Synthetic Construct
  source 1..20: mol_type = other DNA
gaacctgcttgcctggttca

SEQ ID NO: 39894 - DNA, 25 bp, synthetic construct
  misc_feature 1..25: note = Synthetic Construct
  source 1..25: mol_type = other DNA
tgtagtcttttcagactgccctttt

SEQ ID NO: 39895 - DNA, 24 bp, synthetic construct
  misc_feature 1..24: note = Synthetic Construct
  source 1..24: mol_type = other DNA
ccacagttcatcccagtgctgaca

SEQ ID NO: 39896 - DNA, 23 bp, synthetic construct
  misc_feature 1..23: note = Synthetic Construct
  source 1..23: mol_type = other DNA
cctccagaagaaccccaggacat

SEQ ID NO: 39897 - DNA, 25 bp, synthetic construct
  misc_feature 1..25: note = Synthetic Construct
  source 1..25: mol_type = other DNA
tcaccaattctagtctccaggtttc

SEQ ID NO: 39898 - DNA, 22 bp, synthetic construct
  misc_feature 1..22: note = Synthetic Construct
  source 1..22: mol_type = other DNA
ccatggaagggagacaccatgt

SEQ ID NO: 39899 - DNA, 25 bp, synthetic construct
  misc_feature 1..25: note = Synthetic Construct
  source 1..25: mol_type = other DNA
tcatgtgggctgaccattaacttag

SEQ ID NO: 39900 - DNA, 24 bp, synthetic construct
  misc_feature 1..24: note = Synthetic Construct
  source 1..24: mol_type = other DNA
gagcagagaccatgtcaggaaagt

SEQ ID NO: 39901 - DNA, 21 bp, synthetic construct
  misc_feature 1..21: note = Synthetic Construct
  source 1..21: mol_type = other DNA
atggggatgggtcctccatgt

SEQ ID NO: 39902 - DNA, 21 bp, synthetic construct
  misc_feature 1..21: note = Synthetic Construct
  source 1..21: mol_type = other DNA
gtacccaggctgtgggataga

SEQ ID NO: 39903 - DNA, 22 bp, synthetic construct
  misc_feature 1..22: note = Synthetic Construct
  source 1..22: mol_type = other DNA
ccatctccaacttggggcacat

SEQ ID NO: 39904 - DNA, 25 bp, synthetic construct
  misc_feature 1..25: note = Synthetic Construct
  source 1..25: mol_type = other DNA
ttgggacccagaatatggcataaaa

SEQ ID NO: 39905 - DNA, 20 bp, synthetic construct
  misc_feature 1..20: note = Synthetic Construct
  source 1..20: mol_type = other DNA
tctaggctgcggtcagaaga

SEQ ID NO: 39906 - DNA, 26 bp, synthetic construct
  misc_feature 1..26: note = Synthetic Construct
  source 1..26: mol_type = other DNA
gcagaacataacccctagttactaca

SEQ ID NO: 39907 - DNA, 22 bp, synthetic construct
  misc_feature 1..22: note = Synthetic Construct
  source 1..22: mol_type = other DNA
gacacattagctgcctggcaaa

SEQ ID NO: 39908 - DNA, 20 bp, synthetic construct
  misc_feature 1..20: note = Synthetic Construct
  source 1..20: mol_type = other DNA
gctgccagttgctctcaagt

SEQ ID NO: 39909 - DNA, 22 bp, synthetic construct
  misc_feature 1..22: note = Synthetic Construct
  source 1..22: mol_type = other DNA
catcacagagtgtgggttgact

SEQ ID NO: 39910 - DNA, 20 bp, synthetic construct
  misc_feature 1..20: note = Synthetic Construct
  source 1..20: mol_type = other DNA
aggcggcctaaagtctgtgt

SEQ ID NO: 39911 - DNA, 20 bp, synthetic construct
  misc_feature 1..20: note = Synthetic Construct
  source 1..20: mol_type = other DNA
agctggggtttcacgacctt

SEQ ID NO: 39912 - DNA, 18 bp, synthetic construct
  misc_feature 1..18: note = Synthetic Construct
  source 1..18: mol_type = other DNA
caccactgccaccaccat

SEQ ID NO: 39913 - DNA, 18 bp, synthetic construct
  misc_feature 1..18: note = Synthetic Construct
  source 1..18: mol_type = other DNA
tgctgcaccctccctgaa

SEQ ID NO: 39914 - DNA, 23 bp, synthetic construct
  misc_feature 1..23: note = Synthetic Construct
  source 1..23: mol_type = other DNA
ttcgagaagcaacttgacgtaga

SEQ ID NO: 39915 - DNA, 22 bp, synthetic construct
  misc_feature 1..22: note = Synthetic Construct
  source 1..22: mol_type = other DNA
gtctagtgagggcccactttct

SEQ ID NO: 39916 - DNA, 24 bp, synthetic construct
  misc_feature 1..24: note = Synthetic Construct
  source 1..24: mol_type = other DNA
ggctcaggggtaagaacagtggat

SEQ ID NO: 39917 - DNA, 24 bp, synthetic construct
  misc_feature 1..24: note = Synthetic Construct
  source 1..24: mol_type = other DNA
gcagctctggagctctatggaagt

SEQ ID NO: 39918 - DNA, 25 bp, synthetic construct
  misc_feature 1..25: note = Synthetic Construct
  source 1..25: mol_type = other DNA
tctcctccttactagctgtctcttc

SEQ ID NO: 39919 - DNA, 24 bp, synthetic construct
  misc_feature 1..24: note = Synthetic Construct
  source 1..24: mol_type = other DNA
gctccttcctgattcctcacttca

SEQ ID NO: 39920 - DNA, 20 bp, synthetic construct
  misc_feature 1..20: note = Synthetic Construct
  source 1..20: mol_type = other DNA
tgcaggaagccgtcactcat

SEQ ID NO: 39921 - DNA, 19 bp, synthetic construct
  misc_feature 1..19: note = Synthetic Construct
  source 1..19: mol_type = other DNA
agcctgtgggcctcctaga

SEQ ID NO: 39922 - DNA, 26 bp, synthetic construct
  misc_feature 1..26: note = Synthetic Construct
  source 1..26: mol_type = other DNA
ccaccgttttaacttgcactgacatc

SEQ ID NO: 39923 - DNA, 23 bp, synthetic construct
  misc_feature 1..23: note = Synthetic Construct
  source 1..23: mol_type = other DNA
caagcaaaggctgaaccaaatga

SEQ ID NO: 39924 - DNA, 22 bp, synthetic construct
  misc_feature 1..22: note = Synthetic Construct
  source 1..22: mol_type = other DNA
cctccttgacatgcttcaccaa

SEQ ID NO: 39925 - DNA, 20 bp, synthetic construct
  misc_feature 1..20: note = Synthetic Construct
  source 1..20: mol_type = other DNA
gcgctaccaaggcacaaaga

SEQ ID NO: 39926 - DNA, 19 bp, synthetic construct
  misc_feature 1..19: note = Synthetic Construct
  source 1..19: mol_type = other DNA
atgcctggctcaccgaagt

SEQ ID NO: 39927 - DNA, 21 bp, synthetic construct
  misc_feature 1..21: note = Synthetic Construct
  source 1..21: mol_type = other DNA
ccttcaaagtgggcagaggaa

SEQ ID NO: 39928 - DNA, 27 bp, synthetic construct
  misc_feature 1..27: note = Synthetic Construct
  source 1..27: mol_type = other DNA
ggccacagatatctcattgccagttac

SEQ ID NO: 39929 - DNA, 20 bp, synthetic construct
  misc_feature 1..20: note = Synthetic Construct
  source 1..20: mol_type = other DNA
atacgcccctttccctctca

SEQ ID NO: 39930 - DNA, 20 bp, synthetic construct
  misc_feature 1..20: note = Synthetic Construct
  source 1..20: mol_type = other DNA
cggagccctccaggctaaga

SEQ ID NO: 39931 - DNA, 24 bp, synthetic construct
  misc_feature 1..24: note = Synthetic Construct
  source 1..24: mol_type = other DNA
ggcccaaagcaagggtatttcact

SEQ ID NO: 39932 - DNA, 19 bp, synthetic construct
  misc_feature 1..19: note = Synthetic Construct
  source 1..19: mol_type = other DNA
agcctttccccagctgtct

SEQ ID NO: 39933 - DNA, 20 bp, synthetic construct
  misc_feature 1..20: note = Synthetic Construct
  source 1..20: mol_type = other DNA
atcctctgggccttggtgaa

SEQ ID NO: 39934 - DNA, 25 bp, synthetic construct
  misc_feature 1..25: note = Synthetic Construct
  source 1..25: mol_type = other DNA
gcatatcctacttctcggtggcttt

SEQ ID NO: 39935 - DNA, 22 bp, synthetic construct
  misc_feature 1..22: note = Synthetic Construct
  source 1..22: mol_type = other DNA
gggttgcagaaacttggtgagt

SEQ ID NO: 39936 - DNA, 23 bp, synthetic construct
  misc_feature 1..23: note = Synthetic Construct
  source 1..23: mol_type = other DNA
ggaaggaagagcaagcaagaagt

SEQ ID NO: 39937 - DNA, 26 bp, synthetic construct
  misc_feature 1..26: note = Synthetic Construct
  source 1..26: mol_type = other DNA
gctgtggaaagcaagaagtacagttg

SEQ ID NO: 39938 - DNA, 20 bp, synthetic construct
  misc_feature 1..20: note = Synthetic Construct
  source 1..20: mol_type = other DNA
caggcagcatcgtcttctct

SEQ ID NO: 39939 - DNA, 23 bp, synthetic construct
  misc_feature 1..23: note = Synthetic Construct
  source 1..23: mol_type = other DNA
acccaactcagctcctgacttat

SEQ ID NO: 39940 - DNA, 23 bp, synthetic construct
  misc_feature 1..23: note = Synthetic Construct
  source 1..23: mol_type = other DNA
aggtatcaaggggcatgctaaga

SEQ ID NO: 39941 - DNA, 23 bp, synthetic construct
  misc_feature 1..23: note = Synthetic Construct
  source 1..23: mol_type = other DNA
tgccccaagaacaagtgaatcat

SEQ ID NO: 39942 - DNA, 25 bp, synthetic construct
  misc_feature 1..25: note = Synthetic Construct
  source 1..25: mol_type = other DNA
tctcttccacccttagtcaagttca

SEQ ID NO: 39943 - DNA, 26 bp, synthetic construct
  misc_feature 1..26: note = Synthetic Construct
  source 1..26: mol_type = other DNA
catacaacatggaagccttggataag

SEQ ID NO: 39944 - DNA, 21 bp, synthetic construct
  misc_feature 1..21: note = Synthetic Construct
  source 1..21: mol_type = other DNA
gggctaagaggcaggaacaca

SEQ ID NO: 39945 - DNA, 24 bp, synthetic construct
  misc_feature 1..24: note = Synthetic Construct
  source 1..24: mol_type = other DNA
gacatagttggagagcgactgaca

SEQ ID NO: 39946 - DNA, 26 bp, synthetic construct
  misc_feature 1..26: note = Synthetic Construct
  source 1..26: mol_type = other DNA
ggacagagcttccggttatcctcttc

SEQ ID NO: 39947 - DNA, 22 bp, synthetic construct
  misc_feature 1..22: note = Synthetic Construct
  source 1..22: mol_type = other DNA
cgacactgcacgtctcatcaca

SEQ ID NO: 39948 - DNA, 27 bp, synthetic construct
  misc_feature 1..27: note = Synthetic Construct
  source 1..27: mol_type = other DNA
cctgaagccttattcctatcccttcat

SEQ ID NO: 39949 - DNA, 22 bp, synthetic construct
  misc_feature 1..22: note = Synthetic Construct
  source 1..22: mol_type = other DNA
ttgagagtgacctgctgaggta

SEQ ID NO: 39950 - DNA, 23 bp, synthetic construct
  misc_feature 1..23: note = Synthetic Construct
  source 1..23: mol_type = other DNA
cctttcatgatcaccggcagatt

SEQ ID NO: 39951 - DNA, 20 bp, synthetic construct
  misc_feature 1..20: note = Synthetic Construct
  source 1..20: mol_type = other DNA
tggcctgtgtcacccagaaa

SEQ ID NO: 39952 - DNA, 20 bp, synthetic construct
  misc_feature 1..20: note = Synthetic Construct
  source 1..20: mol_type = other DNA
tgctcacccactcccttgtt

SEQ ID NO: 39953 - DNA, 18 bp, synthetic construct
  misc_feature 1..18: note = Synthetic Construct
  source 1..18: mol_type = other DNA
tggtgccagggcccataa

SEQ ID NO: 39954 - DNA, 21 bp, synthetic construct
  misc_feature 1..21: note = Synthetic Construct
  source 1..21: mol_type = other DNA
tccatcctccggcttctactt

SEQ ID NO: 39955 - DNA, 20 bp, synthetic construct
  misc_feature 1..20: note = Synthetic Construct
  source 1..20: mol_type = other DNA
gaatgggaagcagcggatca

SEQ ID NO: 39956 - DNA, 25 bp, synthetic construct
  misc_feature 1..25: note = Synthetic Construct
  source 1..25: mol_type = other DNA
cctcagttggctgagtgagtgataa

SEQ ID NO: 39957 - DNA, 27 bp, synthetic construct
  misc_feature 1..27: note = Synthetic Construct
  source 1..27: mol_type = other DNA
caccatctgccttgatcttatcctgta

SEQ ID NO: 39958 - DNA, 22 bp, synthetic construct
  misc_feature 1..22: note = Synthetic Construct
  source 1..22: mol_type = other DNA
cctgtaccaggtctgggtgatg

SEQ ID NO: 39959 - DNA, 22 bp, synthetic construct
  misc_feature 1..22: note = Synthetic Construct
  source 1..22: mol_type = other DNA
gacctgggtcaaatgccaccta

SEQ ID NO: 39960 - DNA, 22 bp, synthetic construct
  misc_feature 1..22: note = Synthetic Construct
  source 1..22: mol_type = other DNA
ccccttgctcatcacgttgtgt

SEQ ID NO: 39961 - DNA, 22 bp, synthetic construct
  misc_feature 1..22: note = Synthetic Construct
  source 1..22: mol_type = other DNA
cagagcttccctacacctgctt

SEQ ID NO: 39962 - DNA, 23 bp, synthetic construct
  misc_feature 1..23: note = Synthetic Construct
  source 1..23: mol_type = other DNA
ggttatgcctgtcactgaccatt

SEQ ID NO: 39963 - DNA, 21 bp, synthetic construct
  misc_feature 1..21: note = Synthetic Construct
  source 1..21: mol_type = other DNA
atcaaggtggggaggtgagat

SEQ ID NO: 39964 - DNA, 22 bp, synthetic construct
  misc_feature 1..22: note = Synthetic Construct
  source 1..22: mol_type = other DNA
gcaagcaggcttgtctccgttt

SEQ ID NO: 39965 - DNA, 20 bp, synthetic construct
  misc_feature 1..20: note = Synthetic Construct
  source 1..20: mol_type = other DNA
aaggggctggctggttttct

SEQ ID NO: 39966 - DNA, 22 bp, synthetic construct
  misc_feature 1..22: note = Synthetic Construct
  source 1..22: mol_type = other DNA
ctctagagatccccgcatccat

SEQ ID NO: 39967 - DNA, 28 bp, synthetic construct
  misc_feature 1..28: note = Synthetic Construct
  source 1..28: mol_type = other DNA
caccactgacatcatttttcaggtcttg

SEQ ID NO: 39968 - DNA, 21 bp, synthetic construct
  misc_feature 1..21: note = Synthetic Construct
  source 1..21: mol_type = other DNA
acatcacttgttgggcagtga

SEQ ID NO: 39969 - DNA, 21 bp, synthetic construct
  misc_feature 1..21: note = Synthetic Construct
  source 1..21: mol_type = other DNA
tcaggccctgtgtccgaaaga

SEQ ID NO: 39970 - DNA, 22 bp, synthetic construct
  misc_feature 1..22: note = Synthetic Construct
  source 1..22: mol_type = other DNA
acactccaggtagcagggaaca

SEQ ID NO: 39971 - DNA, 20 bp, synthetic construct
  misc_feature 1..20: note = Synthetic Construct
  source 1..20: mol_type = other DNA
gctctgcaaggcagcaattc

SEQ ID NO: 39972 - DNA, 22 bp, synthetic construct
  misc_feature 1..22: note = Synthetic Construct
  source 1..22: mol_type = other DNA
gggagaatggctagctctctgt

SEQ ID NO: 39973 - DNA, 20 bp, synthetic construct
  misc_feature 1..20: note = Synthetic Construct
  source 1..20: mol_type = other DNA
gcagagctggggtttgaact

SEQ ID NO: 39974 - DNA, 23 bp, synthetic construct
  misc_feature 1..23: note = Synthetic Construct
  source 1..23: mol_type = other DNA
gccttgagtgctgaatgctgttc

SEQ ID NO: 39975 - DNA, 20 bp, synthetic construct
  misc_feature 1..20: note = Synthetic Construct
  source 1..20: mol_type = other DNA
tccacgaggaccatccagtt

SEQ ID NO: 39976 - DNA, 25 bp, synthetic construct
  misc_feature 1..25: note = Synthetic Construct
  source 1..25: mol_type = other DNA
cctgctttaggaatgcctgggatga

SEQ ID NO: 39977 - DNA, 25 bp, synthetic construct
  misc_feature 1..25: note = Synthetic Construct
  source 1..25: mol_type = other DNA
cattgcccttaagtccctcctaatc

SEQ ID NO: 39978 - DNA, 22 bp, synthetic construct
  misc_feature 1..22: note = Synthetic Construct
  source 1..22: mol_type = other DNA
gaagttgtggtgctctgaggat

SEQ ID NO: 39979 - DNA, 21 bp, synthetic construct
  misc_feature 1..21: note = Synthetic Construct
  source 1..21: mol_type = other DNA
aaccaggtgctctcccaggaa

SEQ ID NO: 39980 - DNA, 22 bp, synthetic construct
  misc_feature 1..22: note = Synthetic Construct
  source 1..22: mol_type = other DNA
ggatcctggcaaaaggatgtga

SEQ ID NO: 39981 - DNA, 20 bp, synthetic construct
  misc_feature 1..20: note = Synthetic Construct
  source 1..20: mol_type = other DNA
cctgggccacttctctgact

SEQ ID NO: 39982 - DNA, 21 bp, synthetic construct
  misc_feature 1..21: note = Synthetic Construct
  source 1..21: mol_type = other DNA
gtattgctggtggtgggttga

SEQ ID NO: 39983 - DNA, 18 bp, synthetic construct
  misc_feature 1..18: note = Synthetic Construct
  source 1..18: mol_type = other DNA
cactgcacccagccgatt

SEQ ID NO: 39984 - DNA, 22 bp, synthetic construct
  misc_feature 1..22: note = Synthetic Construct
  source 1..22: mol_type = other DNA
ggagccttctcccaatgtcagt

SEQ ID NO: 39985 - DNA, 22 bp, synthetic construct
  misc_feature 1..22: note = Synthetic Construct
  source 1..22: mol_type = other DNA
gccacagcctggaaacatccat

SEQ ID NO: 39986 - DNA, 22 bp, synthetic construct
  misc_feature 1..22: note = Synthetic Construct
  source 1..22: mol_type = other DNA
ggcaggttgctggaactggtta

SEQ ID NO: 39987 - DNA, 22 bp, synthetic construct
  misc_feature 1..22: note = Synthetic Construct
  source 1..22: mol_type = other DNA
cttgcaacaccacagcatcatt

SEQ ID NO: 39988 - DNA, 20 bp, synthetic construct
  misc_feature 1..20: note = Synthetic Construct
  source 1..20: mol_type = other DNA
ggcctcgcagaacagaggta

SEQ ID NO: 39989 - DNA, 23 bp, synthetic construct
  misc_feature 1..23: note = Synthetic Construct
  source 1..23: mol_type = other DNA
ctgtttgtcacagtgggaaggaa

SEQ ID NO: 39990 - DNA, 23 bp, synthetic construct
  misc_feature 1..23: note = Synthetic Construct
  source 1..23: mol_type = other DNA
tctagtctcactgttcccactgt

SEQ ID NO: 39991 - DNA, 26 bp, synthetic construct
  misc_feature 1..26: note = Synthetic Construct
  source 1..26: mol_type = other DNA
gtgtcttggtaattcaatgcctgtag

SEQ ID NO: 39992 - DNA, 24 bp, synthetic construct
  misc_feature 1..24: note = Synthetic Construct
  source 1..24: mol_type = other DNA
ccccacatgtctcctccaaacttc

SEQ ID NO: 39993 - DNA, 19 bp, synthetic construct
  misc_feature 1..19: note = Synthetic Construct
  source 1..19: mol_type = other DNA
gaggtgagctggggagact

SEQ ID NO: 39994 - DNA, 25 bp, synthetic construct
  misc_feature 1..25: note = Synthetic Construct
  source 1..25: mol_type = other DNA
gacacacatcctcaagttagagact

SEQ ID NO: 39995 - DNA, 24 bp, synthetic construct
  misc_feature 1..24: note = Synthetic Construct
  source 1..24: mol_type = other DNA
cctgtttccacctcttgagtcttt

SEQ ID NO: 39996 - DNA, 18 bp, synthetic construct
  misc_feature 1..18: note = Synthetic Construct
  source 1..18: mol_type = other DNA
gcactgtgcgaggcattg

SEQ ID NO: 39997 - DNA, 22 bp, synthetic construct
  misc_feature 1..22: note = Synthetic Construct
  source 1..22: mol_type = other DNA
ttcccgtctgctaccgaagatg

SEQ ID NO: 39998 - DNA, 20 bp, synthetic construct
  misc_feature 1..20: note = Synthetic Construct
  source 1..20: mol_type = other DNA
agaacacgcaggctctggaa

SEQ ID NO: 39999 - DNA, 24 bp, synthetic construct
  misc_feature 1..24: note = Synthetic Construct
  source 1..24: mol_type = other DNA
gaacaattagaccttgcccacaaa

SEQ ID NO: 40000 - DNA, 22 bp, synthetic construct
  misc_feature 1..22: note = Synthetic Construct
  source 1..22: mol_type = other DNA
cctccttcctttgggtctcaag

SEQ ID NO: 40001 - DNA, 20 bp, synthetic construct
  misc_feature 1..20: note = Synthetic Construct
  source 1..20: mol_type = other DNA
agagctgagcagtggggatt

SEQ ID NO: 40002 - DNA, 22 bp, synthetic construct
  misc_feature 1..22: note = Synthetic Construct
  source 1..22: mol_type = other DNA
ctgctaggtttccaagggcaaa

SEQ ID NO: 40003 - DNA, 21 bp, synthetic construct
  misc_feature 1..21: note = Synthetic Construct
  source 1..21: mol_type = other DNA
gggagcaaatggggcaggtat

SEQ ID NO: 40004 - DNA, 22 bp, synthetic construct
  misc_feature 1..22: note = Synthetic Construct
  source 1..22: mol_type = other DNA
gcaggttggctatggcttcact

SEQ ID NO: 40005 - DNA, 23 bp, synthetic construct
  misc_feature 1..23: note = Synthetic Construct
  source 1..23: mol_type = other DNA
gtttgggacaagctgagttgaag

SEQ ID NO: 40006 - DNA, 25 bp, synthetic construct
  misc_feature 1..25: note = Synthetic Construct
  source 1..25: mol_type = other DNA
tcatggataattgaccctgcagtag

SEQ ID NO: 40007 - DNA, 24 bp, synthetic construct
  misc_feature 1..24: note = Synthetic Construct
  source 1..24: mol_type = other DNA
gcagatactgcctcatgtaactct

SEQ ID NO: 40008 - DNA, 23 bp, synthetic construct
  misc_feature 1..23: note = Synthetic Construct
  source 1..23: mol_type = other DNA
gactcagccaatgcctcaatttc

SEQ ID NO: 40009 - DNA, 23 bp, synthetic construct
  misc_feature 1..23: note = Synthetic Construct
  source 1..23: mol_type = other DNA
agctcccagatgatgcttctagt

SEQ ID NO: 40010 - DNA, 19 bp, synthetic construct
  misc_feature 1..19: note = Synthetic Construct
  source 1..19: mol_type = other DNA
gcagtgttggtggctggaa

SEQ ID NO: 40011 - DNA, 22 bp, synthetic construct
  misc_feature 1..22: note = Synthetic Construct
  source 1..22: mol_type = other DNA
ggggagggtgtttgtcatcagt

SEQ ID NO: 40012 - DNA, 20 bp, synthetic construct
  misc_feature 1..20: note = Synthetic Construct
  source 1..20: mol_type = other DNA
gagatgcacggaaccgcatt

SEQ ID NO: 40013 - DNA, 23 bp, synthetic construct
  misc_feature 1..23: note = Synthetic Construct
  source 1..23: mol_type = other DNA
agcagcctgaaccaactaaaaac

SEQ ID NO: 40014 - DNA, 21 bp, synthetic construct
  misc_feature 1..21: note = Synthetic Construct
  source 1..21: mol_type = other DNA
ggaagggagcccctgttgaat

SEQ ID NO: 40015 - DNA, 22 bp, synthetic construct
  misc_feature 1..22: note = Synthetic Construct
  source 1..22: mol_type = other DNA
agtgggatccctgcttttccta

SEQ ID NO: 40016 - DNA, 18 bp, synthetic construct
  misc_feature 1..18: note = Synthetic Construct
  source 1..18: mol_type = other DNA
tctgcccggtgctttgtt

SEQ ID NO: 40017 - DNA, 24 bp, synthetic construct
  misc_feature 1..24: note = Synthetic Construct
  source 1..24: mol_type = other DNA
ctcaactggggtcatggtttcaag

SEQ ID NO: 40018 - DNA, 24 bp, synthetic construct
  misc_feature 1..24: note = Synthetic Construct
  source 1..24: mol_type = other DNA
ccgtgaatcctggctatgggagaa

SEQ ID NO: 40019 - DNA, 21 bp, synthetic construct
  misc_feature 1..21: note = Synthetic Construct
  source 1..21: mol_type = other DNA
aaaggctccctgccctgtagt

SEQ ID NO: 40020 - DNA, 19 bp, synthetic construct
  misc_feature 1..19: note = Synthetic Construct
  source 1..19: mol_type = other DNA
accccacccacctttctct

SEQ ID NO: 40021 - DNA, 24 bp, synthetic construct
  misc_feature 1..24: note = Synthetic Construct
  source 1..24: mol_type = other DNA
ccctgctaagggaggaaagacagt

SEQ ID NO: 40022 - DNA, 26 bp, synthetic construct
  misc_feature 1..26: note = Synthetic Construct
  source 1..26: mol_type = other DNA
gtatctccagatctagggagtaggtt

SEQ ID NO: 40023 - DNA, 20 bp, synthetic construct
  misc_feature 1..20: note = Synthetic Construct
  source 1..20: mol_type = other DNA
cctcgcaaagcacctgaaga

SEQ ID NO: 40024 - DNA, 25 bp, synthetic construct
  misc_feature 1..25: note = Synthetic Construct
  source 1..25: mol_type = other DNA
ggttaggatctcacctgcttgtttg

SEQ ID NO: 40025 - DNA, 19 bp, synthetic construct
  misc_feature 1..19: note = Synthetic Construct
  source 1..19: mol_type = other DNA
tccccgcggaattcagtca

SEQ ID NO: 40026 - DNA, 22 bp, synthetic construct
  misc_feature 1..22: note = Synthetic Construct
  source 1..22: mol_type = other DNA
gtgcatgaaacacaggctgaag

SEQ ID NO: 40027 - DNA, 22 bp, synthetic construct
  misc_feature 1..22: note = Synthetic Construct
  source 1..22: mol_type = other DNA
ccctgccgaatttgcggttatc

SEQ ID NO: 40028 - DNA, 22 bp, synthetic construct
  misc_feature 1..22: note = Synthetic Construct
  source 1..22: mol_type = other DNA
cctcagggtattgagggtggat

SEQ ID NO: 40029 - DNA, 25 bp, synthetic construct
  misc_feature 1..25: note = Synthetic Construct
  source 1..25: mol_type = other DNA
gcttttctgagtaccaaccctcgta

SEQ ID NO: 40030 - DNA, 22 bp, synthetic construct
  misc_feature 1..22: note = Synthetic Construct
  source 1..22: mol_type = other DNA
actgctgtaatccaagcaccaa

SEQ ID NO: 40031 - DNA, 22 bp, synthetic construct
  misc_feature 1..22: note = Synthetic Construct
  source 1..22: mol_type = other DNA
gctcctacagcccttggcttat

SEQ ID NO: 40032 - DNA, 26 bp, synthetic construct
  misc_feature 1..26: note = Synthetic Construct
  source 1..26: mol_type = other DNA
agaacttacaagggctccctattttc

SEQ ID NO: 40033 - DNA, 24 bp, synthetic construct
  misc_feature 1..24: note = Synthetic Construct
  source 1..24: mol_type = other DNA
ggggcatcatagttgccctgagat

SEQ ID NO: 40034 - DNA, 22 bp, synthetic construct
  misc_feature 1..22: note = Synthetic Construct
  source 1..22: mol_type = other DNA
aggaggacttggtaggcacaag

SEQ ID NO: 40035 - DNA, 22 bp, synthetic construct
  misc_feature 1..22: note = Synthetic Construct
  source 1..22: mol_type = other DNA
ggagaagctaggaggtccgaat

SEQ ID NO: 40036 - DNA, 20 bp, synthetic construct
  misc_feature 1..20: note = Synthetic Construct
  source 1..20: mol_type = other DNA
cagcttgtttgcccctggaa

SEQ ID NO: 40037 - DNA, 23 bp, synthetic construct
  misc_feature 1..23: note = Synthetic Construct
  source 1..23: mol_type = other DNA
ccccaaagctaagcatgggaagt

SEQ ID NO: 40038 - DNA, 25 bp, synthetic construct
  misc_feature 1..25: note = Synthetic Construct
  source 1..25: mol_type = other DNA
ccactgcttagaccaaccagctatg

SEQ ID NO: 40039 - DNA, 25 bp, synthetic construct
  misc_feature 1..25: note = Synthetic Construct
  source 1..25: mol_type = other DNA
gtgttactgaagtgcaacaggagat

SEQ ID NO: 40040 - DNA, 27 bp, synthetic construct
  misc_feature 1..27: note = Synthetic Construct
  source 1..27: mol_type = other DNA
gcttgctcaagtacattgtgtcaggtt

SEQ ID NO: 40041 - DNA, 20 bp, synthetic construct
  misc_feature 1..20: note = Synthetic Construct
  source 1..20: mol_type = other DNA
aacaagcccaggccacaaag

SEQ ID NO: 40042 - DNA, 26 bp, synthetic construct
  misc_feature 1..26: note = Synthetic Construct
  source 1..26: mol_type = other DNA
tggggtatgtctatgaacaggagtag

SEQ ID NO: 40043 - DNA, 26 bp, synthetic construct
  misc_feature 1..26: note = Synthetic Construct
  source 1..26: mol_type = other DNA
gacagtgaatcagcagcttaaacaac

SEQ ID NO: 40044 - DNA, 21 bp, synthetic construct
  misc_feature 1..21: note = Synthetic Construct
  source 1..21: mol_type = other DNA
gccagtgctggttgtgtcctt

SEQ ID NO: 40045 - DNA, 23 bp, synthetic construct
  misc_feature 1..23: note = Synthetic Construct
  source 1..23: mol_type = other DNA
cccagaaacttgtcaacccgaat

SEQ ID NO: 40046 - DNA, 20 bp, synthetic construct
  misc_feature 1..20: note = Synthetic Construct
  source 1..20: mol_type = other DNA
cccctcaaccccacatcaca

SEQ ID NO: 40047 - DNA, 25 bp, synthetic construct
  misc_feature 1..25: note = Synthetic Construct
  source 1..25: mol_type = other DNA
gacttatcattccactccgctcaag

SEQ ID NO: 40048 - DNA, 24 bp, synthetic construct
  misc_feature 1..24: note = Synthetic Construct
  source 1..24: mol_type = other DNA
ctccaacttcatcctggaatggtt

SEQ ID NO: 40049 - DNA, 20 bp, synthetic construct
  misc_feature 1..20: note = Synthetic Construct
  source 1..20: mol_type = other DNA
tgggcttggccctgactttg

SEQ ID NO: 40050 - DNA, 21 bp, synthetic construct
  misc_feature 1..21: note = Synthetic Construct
  source 1..21: mol_type = other DNA
cggaggatgacacaggcgtta

SEQ ID NO: 40051 - DNA, 22 bp, synthetic construct
  misc_feature 1..22: note = Synthetic Construct
  source 1..22: mol_type = other DNA
gcccacttgtgtccctctgaat

SEQ ID NO: 40052 - DNA, 23 bp, synthetic construct
  misc_feature 1..23: note = Synthetic Construct
  source 1..23: mol_type = other DNA
tctgggttgctgtcttctctaac

SEQ ID NO: 40053 - DNA, 22 bp, synthetic construct
  misc_feature 1..22: note = Synthetic Construct
  source 1..22: mol_type = other DNA
cagattcacaggcatggtcaga

SEQ ID NO: 40054 - DNA, 26 bp, synthetic construct
  misc_feature 1..26: note = Synthetic Construct
  source 1..26: mol_type = other DNA
gcttacattccctgtgatgctcttag

SEQ ID NO: 40055 - DNA, 22 bp, synthetic construct
  misc_feature 1..22: note = Synthetic Construct
  source 1..22: mol_type = other DNA
ccaggttttgtgtgttgtgtgt

SEQ ID NO: 40056 - DNA, 21 bp, synthetic construct
  misc_feature 1..21: note = Synthetic Construct
  source 1..21: mol_type = other DNA
gccccacagtgttttcctgtt

SEQ ID NO: 40057 - DNA, 21 bp, synthetic construct
  misc_feature 1..21: note = Synthetic Construct
  source 1..21: mol_type = other DNA
ccaagctcactggggctgtta

SEQ ID NO: 40058 - DNA, 21 bp, synthetic construct
  misc_feature 1..21: note = Synthetic Construct
  source 1..21: mol_type = other DNA
tgggacttcaggcttctgtga

SEQ ID NO: 40059 - DNA, 20 bp, synthetic construct
  misc_feature 1..20: note = Synthetic Construct
  source 1..20: mol_type = other DNA
aagggctggtggggtggaaa

SEQ ID NO: 40060 - DNA, 22 bp, synthetic construct
  misc_feature 1..22: note = Synthetic Construct
  source 1..22: mol_type = other DNA
ggtgattggacactgtcaggtt

SEQ ID NO: 40061 - DNA, 23 bp, synthetic construct
  misc_feature 1..23: note = Synthetic Construct
  source 1..23: mol_type = other DNA
ctgataagtccaaccgcctcctt

SEQ ID NO: 40062 - DNA, 22 bp, synthetic construct
  misc_feature 1..22: note = Synthetic Construct
  source 1..22: mol_type = other DNA
gaggcaatgagtcacaggctaa

SEQ ID NO: 40063 - DNA, 21 bp, synthetic construct
  misc_feature 1..21: note = Synthetic Construct
  source 1..21: mol_type = other DNA
gcctgtcgagctaagaaggtt

SEQ ID NO: 40064 - DNA, 23 bp, synthetic construct
  misc_feature 1..23: note = Synthetic Construct
  source 1..23: mol_type = other DNA
cacgtaaaatgtgctgcgtctga

SEQ ID NO: 40065 - DNA, 21 bp, synthetic construct
  misc_feature 1..21: note = Synthetic Construct
  source 1..21: mol_type = other DNA
ctcacccagttccttggcttt

SEQ ID NO: 40066 - DNA, 24 bp, synthetic construct
  misc_feature 1..24: note = Synthetic Construct
  source 1..24: mol_type = other DNA
ggcgttggtgtttggaagggatct

SEQ ID NO: 40067 - DNA, 21 bp, synthetic construct
  misc_feature 1..21: note = Synthetic Construct
  source 1..21: mol_type = other DNA
tgatgcccagtctcactcaca

SEQ ID NO: 40068 - DNA, 22 bp, synthetic construct
  misc_feature 1..22: note = Synthetic Construct
  source 1..22: mol_type = other DNA
gcagcaactaggggcatctgaa

SEQ ID NO: 40069 - DNA, 25 bp, synthetic construct
  misc_feature 1..25: note = Synthetic Construct
  source 1..25: mol_type = other DNA
aaggctctggtctcattaattccat

SEQ ID NO: 40070 - DNA, 24 bp, synthetic construct
  misc_feature 1..24: note = Synthetic Construct
  source 1..24: mol_type = other DNA
tcttggtttactaggggtggcata

SEQ ID NO: 40071 - DNA, 30 bp, synthetic construct
  misc_feature 1..30: note = Synthetic Construct
  source 1..30: mol_type = other DNA
ggaaaagatagctttgatacctccagttac

SEQ ID NO: 40072 - DNA, 20 bp, synthetic construct
  misc_feature 1..20: note = Synthetic Construct
  source 1..20: mol_type = other DNA
ttctggaggtgctggtgact

SEQ ID NO: 40073 - DNA, 25 bp, synthetic construct
  misc_feature 1..25: note = Synthetic Construct
  source 1..25: mol_type = other DNA
acatcagagataagcacctcacttg

SEQ ID NO: 40074 - DNA, 23 bp, synthetic construct
  misc_feature 1..23: note = Synthetic Construct
  source 1..23: mol_type = other DNA
cagctaccaccaagtgcttctga

SEQ ID NO: 40075 - DNA, 24 bp, synthetic construct
  misc_feature 1..24: note = Synthetic Construct
  source 1..24: mol_type = other DNA
gttgtgaagtagcacacacactct

SEQ ID NO: 40076 - DNA, 23 bp, synthetic construct
  misc_feature 1..23: note = Synthetic Construct
  source 1..23: mol_type = other DNA
ccattccttccccactcctgaat

SEQ ID NO: 40077 - DNA, 24 bp, synthetic construct
  misc_feature 1..24: note = Synthetic Construct
  source 1..24: mol_type = other DNA
ggggtttctaaggcacttcaattc

SEQ ID NO: 40078 - DNA, 26 bp, synthetic construct
  misc_feature 1..26: note = Synthetic Construct
  source 1..26: mol_type = other DNA
gggacaaagtctttacatgcagattc

SEQ ID NO: 40079 - DNA, 25 bp, synthetic construct
  misc_feature 1..25: note = Synthetic Construct
  source 1..25: mol_type = other DNA
ggttaggattgagttgggcagattt

SEQ ID NO: 40080 - DNA, 23 bp, synthetic construct
  misc_feature 1..23: note = Synthetic Construct
  source 1..23: mol_type = other DNA
gcccacactcaagcatctacatc

SEQ ID NO: 40081 - DNA, 25 bp, synthetic construct
  misc_feature 1..25: note = Synthetic Construct
  source 1..25: mol_type = other DNA
ttggagaacttacagacagaagcat

SEQ ID NO: 40082 - DNA, 20 bp, synthetic construct
  misc_feature 1..20: note = Synthetic Construct
  source 1..20: mol_type = other DNA
aggcacaccacgaaccttgt

SEQ ID NO: 40083 - DNA, 23 bp, synthetic construct
  misc_feature 1..23: note = Synthetic Construct
  source 1..23: mol_type = other DNA
ggattgcacaaggagcagtggaa

SEQ ID NO: 40084 - DNA, 20 bp, synthetic construct
  misc_feature 1..20: note = Synthetic Construct
  source 1..20: mol_type = other DNA
tgggagagggcacagctttt

SEQ ID NO: 40085 - DNA, 24 bp, synthetic construct
  misc_feature 1..24: note = Synthetic Construct
  source 1..24: mol_type = other DNA
tctgaagatttggtaccccaggat

SEQ ID NO: 40086 - DNA, 25 bp, synthetic construct
  misc_feature 1..25: note = Synthetic Construct
  source 1..25: mol_type = other DNA
ctcataccctcttggtcaccacatt

SEQ ID NO: 40087 - DNA, 20 bp, synthetic construct
  misc_feature 1..20: note = Synthetic Construct
  source 1..20: mol_type = other DNA
aagcgaactggggagctttg

SEQ ID NO: 40088 - DNA, 24 bp, synthetic construct
  misc_feature 1..24: note = Synthetic Construct
  source 1..24: mol_type = other DNA
cgttgctcctaaagccaagacaca

SEQ ID NO: 40089 - DNA, 19 bp, synthetic construct
  misc_feature 1..19: note = Synthetic Construct
  source 1..19: mol_type = other DNA
tggcctgggttgccaggtt

SEQ ID NO: 40090 - DNA, 20 bp, synthetic construct
  misc_feature 1..20: note = Synthetic Construct
  source 1..20: mol_type = other DNA
cctggaggctggcattgtgt

SEQ ID NO: 40091 - DNA, 27 bp, synthetic construct
  misc_feature 1..27: note = Synthetic Construct
  source 1..27: mol_type = other DNA
gctacaagttaaatcctccgaccagat

SEQ ID NO: 40092 - DNA, 21 bp, synthetic construct
  misc_feature 1..21: note = Synthetic Construct
  source 1..21: mol_type = other DNA
ccagctccaaacacaggaaca

SEQ ID NO: 40093 - DNA, 24 bp, synthetic construct
  misc_feature 1..24: note = Synthetic Construct
  source 1..24: mol_type = other DNA
gcttcaaaatgcttcctgcaaact

SEQ ID NO: 40094 - DNA, 24 bp, synthetic construct
  misc_feature 1..24: note = Synthetic Construct
  source 1..24: mol_type = other DNA
cggagtgtcagggtttcgctgtta

SEQ ID NO: 40095 - DNA, 26 bp, synthetic construct
  misc_feature 1..26: note = Synthetic Construct
  source 1..26: mol_type = other DNA
tgcctattctatgggaagctatctct

SEQ ID NO: 40096 - DNA, 23 bp, synthetic construct
  misc_feature 1..23: note = Synthetic Construct
  source 1..23: mol_type = other DNA
acagccagaatgccacataaaca

SEQ ID NO: 40097 - DNA, 21 bp, synthetic construct
  misc_feature 1..21: note = Synthetic Construct
  source 1..21: mol_type = other DNA
tgcagggaatggggtaaggaa

SEQ ID NO: 40098 - DNA, 25 bp, synthetic construct
  misc_feature 1..25: note = Synthetic Construct
  source 1..25: mol_type = other DNA
ctttgaggctagaaaacctgacctt

SEQ ID NO: 40099 - DNA, 21 bp, synthetic construct
  misc_feature 1..21: note = Synthetic Construct
  source 1..21: mol_type = other DNA
tgtccttgagggaggacttga

SEQ ID NO: 40100 - DNA, 24 bp, synthetic construct
  misc_feature 1..24: note = Synthetic Construct
  source 1..24: mol_type = other DNA
gtccctctaagctttcatctgtga

SEQ ID NO: 40101 - DNA, 22 bp, synthetic construct
  misc_feature 1..22: note = Synthetic Construct
  source 1..22: mol_type = other DNA
tttcctctttggagcgtgaaca

SEQ ID NO: 40102 - DNA, 22 bp, synthetic construct
  misc_feature 1..22: note = Synthetic Construct
  source 1..22: mol_type = other DNA
gcaacctgaatgccctctcctt

SEQ ID NO: 40103 - DNA, 23 bp, synthetic construct
  misc_feature 1..23: note = Synthetic Construct
  source 1..23: mol_type = other DNA
gctcaatgcattcacaggacaaa

SEQ ID NO: 40104 - DNA, 24 bp, synthetic construct
  misc_feature 1..24: note = Synthetic Construct
  source 1..24: mol_type = other DNA
gggtgtaaatgacagctccaccat

SEQ ID NO: 40105 - DNA, 23 bp, synthetic construct
  misc_feature 1..23: note = Synthetic Construct
  source 1..23: mol_type = other DNA
ccctttcactccaccctgttgat

SEQ ID NO: 40106 - DNA, 18 bp, synthetic construct
  misc_feature 1..18: note = Synthetic Construct
  source 1..18: mol_type = other DNA
tgcccagtggcagccata

SEQ ID NO: 40107 - DNA, 19 bp, synthetic construct
  misc_feature 1..19: note = Synthetic Construct
  source 1..19: mol_type = other DNA
tggacttccccagctcgtt

SEQ ID NO: 40108 - DNA, 22 bp, synthetic construct
  misc_feature 1..22: note = Synthetic Construct
  source 1..22: mol_type = other DNA
ggcaaacatcccctgcttctct

SEQ ID NO: 40109 - DNA, 24 bp, synthetic construct
  misc_feature 1..24: note = Synthetic Construct
  source 1..24: mol_type = other DNA
tgcatagctccttatcccactttg

SEQ ID NO: 40110 - DNA, 19 bp, synthetic construct
  misc_feature 1..19: note = Synthetic Construct
  source 1..19: mol_type = other DNA
tcgtgggcaggcagtagta

SEQ ID NO: 40111 - DNA, 25 bp, synthetic construct
  misc_feature 1..25: note = Synthetic Construct
  source 1..25: mol_type = other DNA
cctgggaactttctggttgccatag

SEQ ID NO: 40112 - DNA, 27 bp, synthetic construct
  misc_feature 1..27: note = Synthetic Construct
  source 1..27: mol_type = other DNA
caattaagcatcacagtgtctgtccta

SEQ ID NO: 40113 - DNA, 18 bp, synthetic construct
  misc_feature 1..18: note = Synthetic Construct
  source 1..18: mol_type = other DNA
tgtccagctgcggtgagt

SEQ ID NO: 40114 - DNA, 20 bp, synthetic construct
  misc_feature 1..20: note = Synthetic Construct
  source 1..20: mol_type = other DNA
gccagtggctcctgatctga

SEQ ID NO: 40115 - DNA, 22 bp, synthetic construct
  misc_feature 1..22: note = Synthetic Construct
  source 1..22: mol_type = other DNA
gctcccctgagattgtggtgaa

SEQ ID NO: 40116 - DNA, 23 bp, synthetic construct
  misc_feature 1..23: note = Synthetic Construct
  source 1..23: mol_type = other DNA
tcttcaattgcctcaaggcctaa

SEQ ID NO: 40117 - DNA, 25 bp, synthetic construct
  misc_feature 1..25: note = Synthetic Construct
  source 1..25: mol_type = other DNA
ccaagtaattctgcccctcctcctt

SEQ ID NO: 40118 - DNA, 22 bp, synthetic construct
  misc_feature 1..22: note = Synthetic Construct
  source 1..22: mol_type = other DNA
ccctcgcaaccaaacaccctta

SEQ ID NO: 40119 - DNA, 24 bp, synthetic construct
  misc_feature 1..24: note = Synthetic Construct
  source 1..24: mol_type = other DNA
tggtgttcggaagtctatgtttga

SEQ ID NO: 40120 - DNA, 29 bp, synthetic construct
  misc_feature 1..29: note = Synthetic Construct
  source 1..29: mol_type = other DNA
gctgagtagaatagctcaggttgtaggta

SEQ ID NO: 40121 - DNA, 20 bp, synthetic construct
  misc_feature 1..20: note = Synthetic Construct
  source 1..20: mol_type = other DNA
tccacagccccatcccattt

SEQ ID NO: 40122 - DNA, 26 bp, synthetic construct
  misc_feature 1..26: note = Synthetic Construct
  source 1..26: mol_type = other DNA
gaaggctgtcaaactgctaatcttac

SEQ ID NO: 40123 - DNA, 25 bp, synthetic construct
  misc_feature 1..25: note = Synthetic Construct
  source 1..25: mol_type = other DNA
ggagcatgtaagctagtgagccatt

SEQ ID NO: 40124 - DNA, 21 bp, synthetic construct
  misc_feature 1..21: note = Synthetic Construct
  source 1..21: mol_type = other DNA
atgcggaggtccgtcctatgt

SEQ ID NO: 40125 - DNA, 22 bp, synthetic construct
  misc_feature 1..22: note = Synthetic Construct
  source 1..22: mol_type = other DNA
tcaggagtccaggtgaggctta

SEQ ID NO: 40126 - DNA, 20 bp, synthetic construct
  misc_feature 1..20: note = Synthetic Construct
  source 1..20: mol_type = other DNA
agctgttgcagccctctact

SEQ ID NO: 40127 - DNA, 23 bp, synthetic construct
  misc_feature 1..23: note = Synthetic Construct
  source 1..23: mol_type = other DNA
ggatagtggaaactgccgtggaa

SEQ ID NO: 40128 - DNA, 23 bp, synthetic construct
  misc_feature 1..23: note = Synthetic Construct
  source 1..23: mol_type = other DNA
aggcctgaagatatgaccaccta

SEQ ID NO: 40129 - DNA, 25 bp, synthetic construct
  misc_feature 1..25: note = Synthetic Construct
  source 1..25: mol_type = other DNA
ccagagctgtagcattttcactact

SEQ ID NO: 40130 - DNA, 22 bp, synthetic construct
  misc_feature 1..22: note = Synthetic Construct
  source 1..22: mol_type = other DNA
aggctgtcaccacactctcaag

SEQ ID NO: 40131 - DNA, 20 bp, synthetic construct
  misc_feature 1..20: note = Synthetic Construct
  source 1..20: mol_type = other DNA
gttccccaggaggtgtcaga

SEQ ID NO: 40132 - DNA, 22 bp, synthetic construct
  misc_feature 1..22: note = Synthetic Construct
  source 1..22: mol_type = other DNA
tcactggagtgagtgcctctat

SEQ ID NO: 40133 - DNA, 22 bp, synthetic construct
  misc_feature 1..22: note = Synthetic Construct
  source 1..22: mol_type = other DNA
gccaaagcagcactgtaagttg

SEQ ID NO: 40134 - DNA, 20 bp, synthetic construct
  misc_feature 1..20: note = Synthetic Construct
  source 1..20: mol_type = other DNA
ggagccaggtgggatgcttt

SEQ ID NO: 40135 - DNA, 22 bp, synthetic construct
  misc_feature 1..22: note = Synthetic Construct
  source 1..22: mol_type = other DNA
ccatgacctgtggggttctgtt

SEQ ID NO: 40136 - DNA, 20 bp, synthetic construct
  misc_feature 1..20: note = Synthetic Construct
  source 1..20: mol_type = other DNA
aggccactcctggccatcaa

SEQ ID NO: 40137 - DNA, 25 bp, synthetic construct
  misc_feature 1..25: note = Synthetic Construct
  source 1..25: mol_type = other DNA
ggagaaacagagaagaacaccattg

SEQ ID NO: 40138 - DNA, 21 bp, synthetic construct
  misc_feature 1..21: note = Synthetic Construct
  source 1..21: mol_type = other DNA
gccagatgatcaagccactct

SEQ ID NO: 40139 - DNA, 21 bp, synthetic construct
  misc_feature 1..21: note = Synthetic Construct
  source 1..21: mol_type = other DNA
ctgggactccatcctctctca

SEQ ID NO: 40140 - DNA, 20 bp, synthetic construct
  misc_feature 1..20: note = Synthetic Construct
  source 1..20: mol_type = other DNA
cacggagacgctctcccata

SEQ ID NO: 40141 - DNA, 21 bp, synthetic construct
  misc_feature 1..21: note = Synthetic Construct
  source 1..21: mol_type = other DNA
agagaaaaccgtggcacagaa

SEQ ID NO: 40142 - DNA, 22 bp, synthetic construct
  misc_feature 1..22: note = Synthetic Construct
  source 1..22: mol_type = other DNA
tggtcaaggactgccaagacta

SEQ ID NO: 40143 - DNA, 26 bp, synthetic construct
  misc_feature 1..26: note = Synthetic Construct
  source 1..26: mol_type = other DNA
agcacaaggagagtagggatttttac

SEQ ID NO: 40144 - DNA, 25 bp, synthetic construct
  misc_feature 1..25: note = Synthetic Construct
  source 1..25: mol_type = other DNA
gtttccaggagtttcacgaacctaa

SEQ ID NO: 40145 - DNA, 21 bp, synthetic construct
  misc_feature 1..21: note = Synthetic Construct
  source 1..21: mol_type = other DNA
aagactgtggcccagctccat

SEQ ID NO: 40146 - DNA, 21 bp, synthetic construct
  misc_feature 1..21: note = Synthetic Construct
  source 1..21: mol_type = other DNA
aagtggtggaagggccaggta

SEQ ID NO: 40147 - DNA, 20 bp, synthetic construct
  misc_feature 1..20: note = Synthetic Construct
  source 1..20: mol_type = other DNA
aacctcacaacccgcagtgt

SEQ ID NO: 40148 - DNA, 24 bp, synthetic construct
  misc_feature 1..24: note = Synthetic Construct
  source 1..24: mol_type = other DNA
acagagaacaggtacagccatact

SEQ ID NO: 40149 - DNA, 22 bp, synthetic construct
  misc_feature 1..22: note = Synthetic Construct
  source 1..22: mol_type = other DNA
tcagctagccactgggagatgt

SEQ ID NO: 40150 - DNA, 27 bp, synthetic construct
  misc_feature 1..27: note = Synthetic Construct
  source 1..27: mol_type = other DNA
cgtgtgctaatgaggaaaagagagctt

SEQ ID NO: 40151 - DNA, 21 bp, synthetic construct
  misc_feature 1..21: note = Synthetic Construct
  source 1..21: mol_type = other DNA
tctaatggggcagggcctttg

SEQ ID NO: 40152 - DNA, 24 bp, synthetic construct
  misc_feature 1..24: note = Synthetic Construct
  source 1..24: mol_type = other DNA
ccactcctccttcacctcctttct

SEQ ID NO: 40153 - DNA, 21 bp, synthetic construct
  misc_feature 1..21: note = Synthetic Construct
  source 1..21: mol_type = other DNA
atggcgcaggtcgggagtgat

SEQ ID NO: 40154 - DNA, 20 bp, synthetic construct
  misc_feature 1..20: note = Synthetic Construct
  source 1..20: mol_type = other DNA
tgtgtggagcccaggactga

SEQ ID NO: 40155 - DNA, 23 bp, synthetic construct
  misc_feature 1..23: note = Synthetic Construct
  source 1..23: mol_type = other DNA
tcccgaaattcatctctgcactt

SEQ ID NO: 40156 - DNA, 26 bp, synthetic construct
  misc_feature 1..26: note = Synthetic Construct
  source 1..26: mol_type = other DNA
tgatctgatcttggatgtgaggacta

SEQ ID NO: 40157 - DNA, 24 bp, synthetic construct
  misc_feature 1..24: note = Synthetic Construct
  source 1..24: mol_type = other DNA
gtccctaacaccatgttgcctctt

SEQ ID NO: 40158 - DNA, 26 bp, synthetic construct
  misc_feature 1..26: note = Synthetic Construct
  source 1..26: mol_type = other DNA
gcttctgagtgcttccttttcagtgt

SEQ ID NO: 40159 - DNA, 25 bp, synthetic construct
  misc_feature 1..25: note = Synthetic Construct
  source 1..25: mol_type = other DNA
aatgggattatcatgtgcctcagaa

SEQ ID NO: 40160 - DNA, 25 bp, synthetic construct
  misc_feature 1..25: note = Synthetic Construct
  source 1..25: mol_type = other DNA
tggggtagtgaaggattgattcaga

SEQ ID NO: 40161 - DNA, 26 bp, synthetic construct
  misc_feature 1..26: note = Synthetic Construct
  source 1..26: mol_type = other DNA
ggtcaggaaccaagtttaggctttag

SEQ ID NO: 40162 - DNA, 23 bp, synthetic construct
  misc_feature 1..23: note = Synthetic Construct
  source 1..23: mol_type = other DNA
gaaagagtcacccatagcacaga

SEQ ID NO: 40163 - DNA, 22 bp, synthetic construct
  misc_feature 1..22: note = Synthetic Construct
  source 1..22: mol_type = other DNA
ttgttttgcaggggttggtttc

SEQ ID NO: 40164 - DNA, 27 bp, synthetic construct
  misc_feature 1..27: note = Synthetic Construct
  source 1..27: mol_type = other DNA
ctgcagagaaatctgtcatcactctgt

SEQ ID NO: 40165 - DNA, 25 bp, synthetic construct
  misc_feature 1..25: note = Synthetic Construct
  source 1..25: mol_type = other DNA
ggacaagaacaagtgcgagaagaag

SEQ ID NO: 40166 - DNA, 22 bp, synthetic construct
  misc_feature 1..22: note = Synthetic Construct
  source 1..22: mol_type = other DNA
cggttttctcctggtggtttga

SEQ ID NO: 40167 - DNA, 22 bp, synthetic construct
  misc_feature 1..22: note = Synthetic Construct
  source 1..22: mol_type = other DNA
cacggctggatgtctcatcaac

SEQ ID NO: 40168 - DNA, 25 bp, synthetic construct
  misc_feature 1..25: note = Synthetic Construct
  source 1..25: mol_type = other DNA
ctggggtccagtaaggagtatgttt

SEQ ID NO: 40169 - DNA, 26 bp, synthetic construct
  misc_feature 1..26: note = Synthetic Construct
  source 1..26: mol_type = other DNA
caaattctaactctcacaccccttgt

SEQ ID NO: 40170 - DNA, 22 bp, synthetic construct
  misc_feature 1..22: note = Synthetic Construct
  source 1..22: mol_type = other DNA
ccggtggggctaagattctaac

SEQ ID NO: 40171 - DNA, 23 bp, synthetic construct
  misc_feature 1..23: note = Synthetic Construct
  source 1..23: mol_type = other DNA
taccgcaaggcaatagacagcat

SEQ ID NO: 40172 - DNA, 20 bp, synthetic construct
  misc_feature 1..20: note = Synthetic Construct
  source 1..20: mol_type = other DNA
ggcatagccagcaggaatgt

SEQ ID NO: 40173 - DNA, 20 bp, synthetic construct
  misc_feature 1..20: note = Synthetic Construct
  source 1..20: mol_type = other DNA
tcctggggtctgcagcagtt

SEQ ID NO: 40174 - DNA, 22 bp, synthetic construct
  misc_feature 1..22: note = Synthetic Construct
  source 1..22: mol_type = other DNA
gagcagaccctcctgaagatgt

SEQ ID NO: 40175 - DNA, 22 bp, synthetic construct
  misc_feature 1..22: note = Synthetic Construct
  source 1..22: mol_type = other DNA
gctgaagtgcaagaggatcgta

SEQ ID NO: 40176 - DNA, 22 bp, synthetic construct
  misc_feature 1..22: note = Synthetic Construct
  source 1..22: mol_type = other DNA
cctgggatgggaaactggtgtt

SEQ ID NO: 40177 - DNA, 25 bp, synthetic construct
  misc_feature 1..25: note = Synthetic Construct
  source 1..25: mol_type = other DNA
gttagttagttcctcctgcctgaag

SEQ ID NO: 40178 - DNA, 25 bp, synthetic construct
  misc_feature 1..25: note = Synthetic Construct
  source 1..25: mol_type = other DNA
ccaaattgtgactagaccccagaca

SEQ ID NO: 40179 - DNA, 25 bp, synthetic construct
  misc_feature 1..25: note = Synthetic Construct
  source 1..25: mol_type = other DNA
gagttgtttcatttggctcaagtct

SEQ ID NO: 40180 - DNA, 23 bp, synthetic construct
  misc_feature 1..23: note = Synthetic Construct
  source 1..23: mol_type = other DNA
gctcatgaactgtaggcccttct

SEQ ID NO: 40181 - DNA, 25 bp, synthetic construct
  misc_feature 1..25: note = Synthetic Construct
  source 1..25: mol_type = other DNA
ttagcccaagtacaggactttcttt

SEQ ID NO: 40182 - DNA, 30 bp, synthetic construct
  misc_feature 1..30: note = Synthetic Construct
  source 1..30: mol_type = other DNA
ccactagataacaatagcacctaccagttg

SEQ ID NO: 40183 - DNA, 22 bp, synthetic construct
  misc_feature 1..22: note = Synthetic Construct
  source 1..22: mol_type = other DNA
gccctgtaggaccagttcactt

SEQ ID NO: 40184 - DNA, 23 bp, synthetic construct
  misc_feature 1..23: note = Synthetic Construct
  source 1..23: mol_type = other DNA
ccacagttaacctgctcatggaa

SEQ ID NO: 40185 - DNA, 27 bp, synthetic construct
  misc_feature 1..27: note = Synthetic Construct
  source 1..27: mol_type = other DNA
gctcctgatgaaatttttcagcgtctt

SEQ ID NO: 40186 - DNA, 21 bp, synthetic construct
  misc_feature 1..21: note = Synthetic Construct
  source 1..21: mol_type = other DNA
agccgattggtgtcagacatt

SEQ ID NO: 40187 - DNA, 26 bp, synthetic construct
  misc_feature 1..26: note = Synthetic Construct
  source 1..26: mol_type = other DNA
gatgagaagagtcagatcaacccatt

SEQ ID NO: 40188 - DNA, 29 bp, synthetic construct
  misc_feature 1..29: note = Synthetic Construct
  source 1..29: mol_type = other DNA
gggctatgaattaaggagaaatgctgttg

SEQ ID NO: 40189 - DNA, 22 bp, synthetic construct
  misc_feature 1..22: note = Synthetic Construct
  source 1..22: mol_type = other DNA
cacctctatgtggggctgttag

SEQ ID NO: 40190 - DNA, 26 bp, synthetic construct
  misc_feature 1..26: note = Synthetic Construct
  source 1..26: mol_type = other DNA
gcttaggtgaaggagaataaccatga

SEQ ID NO: 40191 - DNA, 21 bp, synthetic construct
  misc_feature 1..21: note = Synthetic Construct
  source 1..21: mol_type = other DNA
tcagagggttccccagatcaa

SEQ ID NO: 40192 - DNA, 26 bp, synthetic construct
  misc_feature 1..26: note = Synthetic Construct
  source 1..26: mol_type = other DNA
tgtctctcatcctaccttgactctta

SEQ ID NO: 40193 - DNA, 25 bp, synthetic construct
  misc_feature 1..25: note = Synthetic Construct
  source 1..25: mol_type = other DNA
ggaccaaaccaactgaaaacctgta

SEQ ID NO: 40194 - DNA, 21 bp, synthetic construct
  misc_feature 1..21: note = Synthetic Construct
  source 1..21: mol_type = other DNA
agaggcagggtttggggtaga

SEQ ID NO: 40195 - DNA, 24 bp, synthetic construct
  misc_feature 1..24: note = Synthetic Construct
  source 1..24: mol_type = other DNA
ttgactccatgtccactgttttct

SEQ ID NO: 40196 - DNA, 21 bp, synthetic construct
  misc_feature 1..21: note = Synthetic Construct
  source 1..21: mol_type = other DNA
ttcagtgggagggagagttga

SEQ ID NO: 40197 - DNA, 23 bp, synthetic construct
  misc_feature 1..23: note = Synthetic Construct
  source 1..23: mol_type = other DNA
ccagatgactgcttctccagcat

SEQ ID NO: 40198 - DNA, 22 bp, synthetic construct
  misc_feature 1..22: note = Synthetic Construct
  source 1..22: mol_type = other DNA
ggaaagacagaggacgaggttt

SEQ ID NO: 40199 - DNA, 20 bp, synthetic construct
  misc_feature 1..20: note = Synthetic Construct
  source 1..20: mol_type = other DNA
gctggaaaaccaggggaact

SEQ ID NO: 40200 - DNA, 22 bp, synthetic construct
  misc_feature 1..22: note = Synthetic Construct
  source 1..22: mol_type = other DNA
tgcagacatggggaaggcctaa

SEQ ID NO: 40201 - DNA, 24 bp, synthetic construct
  misc_feature 1..24: note = Synthetic Construct
  source 1..24: mol_type = other DNA
gccaagattgagcagcatttcctt

SEQ ID NO: 40202 - DNA, 24 bp, synthetic construct
  misc_feature 1..24: note = Synthetic Construct
  source 1..24: mol_type = other DNA
acaaacacttgctacactgagaga

SEQ ID NO: 40203 - DNA, 20 bp, synthetic construct
  misc_feature 1..20: note = Synthetic Construct
  source 1..20: mol_type = other DNA
ttcgtcacgctggtggtgtt

SEQ ID NO: 40204 - DNA, 20 bp, synthetic construct
  misc_feature 1..20: note = Synthetic Construct
  source 1..20: mol_type = other DNA
ccacctgggaacgactctga

SEQ ID NO: 40205 - DNA, 25 bp, synthetic construct
  misc_feature 1..25: note = Synthetic Construct
  source 1..25: mol_type = other DNA
ggcaagtactattctgtgggaggat

SEQ ID NO: 40206 - DNA, 27 bp, synthetic construct
  misc_feature 1..27: note = Synthetic Construct
  source 1..27: mol_type = other DNA
tttgtacagggctggtactatgataag

SEQ ID NO: 40207 - DNA, 25 bp, synthetic construct
  misc_feature 1..25: note = Synthetic Construct
  source 1..25: mol_type = other DNA
gctgaggttttcacattgggactga

SEQ ID NO: 40208 - DNA, 19 bp, synthetic construct
  misc_feature 1..19: note = Synthetic Construct
  source 1..19: mol_type = other DNA
gctgcggaccccgtttagt

SEQ ID NO: 40209 - DNA, 24 bp, synthetic construct
  misc_feature 1..24: note = Synthetic Construct
  source 1..24: mol_type = other DNA
gctgcctttattaagcccctactt

SEQ ID NO: 40210 - DNA, 24 bp, synthetic construct
  misc_feature 1..24: note = Synthetic Construct
  source 1..24: mol_type = other DNA
gttagcacagctgacctaggatac

SEQ ID NO: 40211 - DNA, 25 bp, synthetic construct
  misc_feature 1..25: note = Synthetic Construct
  source 1..25: mol_type = other DNA
agagaagaatgtactggcgaagaaa

SEQ ID NO: 40212 - DNA, 20 bp, synthetic construct
  misc_feature 1..20: note = Synthetic Construct
  source 1..20: mol_type = other DNA
tgccaagggccggactaaca

SEQ ID NO: 40213 - DNA, 20 bp, synthetic construct
  misc_feature 1..20: note = Synthetic Construct
  source 1..20: mol_type = other DNA
agtatcgggcctccttgtgt

SEQ ID NO: 40214 - DNA, 22 bp, synthetic construct
  misc_feature 1..22: note = Synthetic Construct
  source 1..22: mol_type = other DNA
gaggcaaatatcagcccagtga

SEQ ID NO: 40215 - DNA, 21 bp, synthetic construct
  misc_feature 1..21: note = Synthetic Construct
  source 1..21: mol_type = other DNA
tgggagcctcacctgtctttg

SEQ ID NO: 40216 - DNA, 24 bp, synthetic construct
  misc_feature 1..24: note = Synthetic Construct
  source 1..24: mol_type = other DNA
catttcaaaggcagtgtgggtaga

SEQ ID NO: 40217 - DNA, 25 bp, synthetic construct
  misc_feature 1..25: note = Synthetic Construct
  source 1..25: mol_type = other DNA
ccttccacgtcattccactggtcta

SEQ ID NO: 40218 - DNA, 21 bp, synthetic construct
  misc_feature 1..21: note = Synthetic Construct
  source 1..21: mol_type = other DNA
ggacttgccagggaagctact

SEQ ID NO: 40219 - DNA, 24 bp, synthetic construct
  misc_feature 1..24: note = Synthetic Construct
  source 1..24: mol_type = other DNA
acataaagccaaggacagatgtga

SEQ ID NO: 40220 - DNA, 19 bp, synthetic construct
  misc_feature 1..19: note = Synthetic Construct
  source 1..19: mol_type = other DNA
gcagcagcccagggttaaa

SEQ ID NO: 40221 - DNA, 22 bp, synthetic construct
  misc_feature 1..22: note = Synthetic Construct
  source 1..22: mol_type = other DNA
gccacaaacctccactcctaac

SEQ ID NO: 40222 - DNA, 23 bp, synthetic construct
  misc_feature 1..23: note = Synthetic Construct
  source 1..23: mol_type = other DNA
ccttctaggcctctaagctggtt

SEQ ID NO: 40223 - DNA, 22 bp, synthetic construct
  misc_feature 1..22: note = Synthetic Construct
  source 1..22: mol_type = other DNA
tcctgcacgtgaagaagaaaga

SEQ ID NO: 40224 - DNA, 24 bp, synthetic construct
  misc_feature 1..24: note = Synthetic Construct
  source 1..24: mol_type = other DNA
cctctctggaaaactggcccaata

SEQ ID NO: 40225 - DNA, 22 bp, synthetic construct
  misc_feature 1..22: note = Synthetic Construct
  source 1..22: mol_type = other DNA
gtccctggggcaaaagttgaga

SEQ ID NO: 40226 - DNA, 20 bp, synthetic construct
  misc_feature 1..20: note = Synthetic Construct
  source 1..20: mol_type = other DNA
ggagcttctggcatccagtt

SEQ ID NO: 40227 - DNA, 24 bp, synthetic construct
  misc_feature 1..24: note = Synthetic Construct
  source 1..24: mol_type = other DNA
actatggagcaccaggatgtatga

SEQ ID NO: 40228 - DNA, 21 bp, synthetic construct
  misc_feature 1..21: note = Synthetic Construct
  source 1..21: mol_type = other DNA
tcgacgacaccactggagaca

SEQ ID NO: 40229 - DNA, 22 bp, synthetic construct
  misc_feature 1..22: note = Synthetic Construct
  source 1..22: mol_type = other DNA
ctgcagagtgcccttgaacttg

SEQ ID NO: 40230 - DNA, 23 bp, synthetic construct
  misc_feature 1..23: note = Synthetic Construct
  source 1..23: mol_type = other DNA
gctttagctactgtggtcacctt

SEQ ID NO: 40231 - DNA, 20 bp, synthetic construct
  misc_feature 1..20: note = Synthetic Construct
  source 1..20: mol_type = other DNA
agccagcagagcgtggagat

SEQ ID NO: 40232 - DNA, 21 bp, synthetic construct
  misc_feature 1..21: note = Synthetic Construct
  source 1..21: mol_type = other DNA
ggcaaagcatccacccatctt

SEQ ID NO: 40233 - DNA, 21 bp, synthetic construct
  misc_feature 1..21: note = Synthetic Construct
  source 1..21: mol_type = other DNA
tgagcctgccaccagatggat

SEQ ID NO: 40234 - DNA, 24 bp, synthetic construct
  misc_feature 1..24: note = Synthetic Construct
  source 1..24: mol_type = other DNA
ggggagaaattccagcttctgtga

SEQ ID NO: 40235 - DNA, 26 bp, synthetic construct
  misc_feature 1..26: note = Synthetic Construct
  source 1..26: mol_type = other DNA
agccatatgtctctttgaggaagaac

SEQ ID NO: 40236 - DNA, 23 bp, synthetic construct
  misc_feature 1..23: note = Synthetic Construct
  source 1..23: mol_type = other DNA
cccctactcccatgtcactcctt

SEQ ID NO: 40237 - DNA, 27 bp, synthetic construct
  misc_feature 1..27: note = Synthetic Construct
  source 1..27: mol_type = other DNA
cccttgtgtaagagtcccttgtgtaag

SEQ ID NO: 40238 - DNA, 24 bp, synthetic construct
  misc_feature 1..24: note = Synthetic Construct
  source 1..24: mol_type = other DNA
ctcccactatcactgggaatgagt

SEQ ID NO: 40239 - DNA, 26 bp, synthetic construct
  misc_feature 1..26: note = Synthetic Construct
  source 1..26: mol_type = other DNA
gcccacatttctaccctctgattatg

SEQ ID NO: 40240 - DNA, 25 bp, synthetic construct
  misc_feature 1..25: note = Synthetic Construct
  source 1..25: mol_type = other DNA
gatagtaatgcagctcttcgagtca

SEQ ID NO: 40241 - DNA, 22 bp, synthetic construct
  misc_feature 1..22: note = Synthetic Construct
  source 1..22: mol_type = other DNA
gcccagattcaactggccacaa

SEQ ID NO: 40242 - DNA, 23 bp, synthetic construct
  misc_feature 1..23: note = Synthetic Construct
  source 1..23: mol_type = other DNA
acaacaaacatgggacctgaaca

SEQ ID NO: 40243 - DNA, 23 bp, synthetic construct
  misc_feature 1..23: note = Synthetic Construct
  source 1..23: mol_type = other DNA
aataggacctgagcgagttgaag

SEQ ID NO: 40244 - DNA, 19 bp, synthetic construct
  misc_feature 1..19: note = Synthetic Construct
  source 1..19: mol_type = other DNA
tcacccagcagctttgctt

SEQ ID NO: 40245 - DNA, 20 bp, synthetic construct
  misc_feature 1..20: note = Synthetic Construct
  source 1..20: mol_type = other DNA
cacacacaccccaggctagt

SEQ ID NO: 40246 - DNA, 21 bp, synthetic construct
  misc_feature 1..21: note = Synthetic Construct
  source 1..21: mol_type = other DNA
tcctagcctgtgcccaacctt

SEQ ID NO: 40247 - DNA, 22 bp, synthetic construct
  misc_feature 1..22: note = Synthetic Construct
  source 1..22: mol_type = other DNA
gcaccttaagagctgggtctgt

SEQ ID NO: 40248 - DNA, 20 bp, synthetic construct
  misc_feature 1..20: note = Synthetic Construct
  source 1..20: mol_type = other DNA
tcccacaccaaaccccaagt

SEQ ID NO: 40249 - DNA, 21 bp, synthetic construct
  misc_feature 1..21: note = Synthetic Construct
  source 1..21: mol_type = other DNA
aggcttcttggcccctcctaa

SEQ ID NO: 40250 - DNA, 22 bp, synthetic construct
  misc_feature 1..22: note = Synthetic Construct
  source 1..22: mol_type = other DNA
tgtctacctctctgccacttct

SEQ ID NO: 40251 - DNA, 19 bp, synthetic construct
  misc_feature 1..19: note = Synthetic Construct
  source 1..19: mol_type = other DNA
agggtgtggggctgcagat

SEQ ID NO: 40252 - DNA, 23 bp, synthetic construct
  misc_feature 1..23: note = Synthetic Construct
  source 1..23: mol_type = other DNA
ctgtgtctgagcaaggtctgctt

SEQ ID NO: 40253 - DNA, 24 bp, synthetic construct
  misc_feature 1..24: note = Synthetic Construct
  source 1..24: mol_type = other DNA
ccagcagagatggactggagtttc

SEQ ID NO: 40254 - DNA, 22 bp, synthetic construct
  misc_feature 1..22: note = Synthetic Construct
  source 1..22: mol_type = other DNA
ggattccagaatgtgcgtggat

SEQ ID NO: 40255 - DNA, 19 bp, synthetic construct
  misc_feature 1..19: note = Synthetic Construct
  source 1..19: mol_type = other DNA
cgaaccccgtttgccttca

SEQ ID NO: 40256 - DNA, 23 bp, synthetic construct
  misc_feature 1..23: note = Synthetic Construct
  source 1..23: mol_type = other DNA
ccgaaatcaaggcatcagcagta

SEQ ID NO: 40257 - DNA, 20 bp, synthetic construct
  misc_feature 1..20: note = Synthetic Construct
  source 1..20: mol_type = other DNA
agttcacggttccccacatc

SEQ ID NO: 40258 - DNA, 22 bp, synthetic construct
  misc_feature 1..22: note = Synthetic Construct
  source 1..22: mol_type = other DNA
ggaggctcctaagctgcatttg

SEQ ID NO: 40259 - DNA, 21 bp, synthetic construct
  misc_feature 1..21: note = Synthetic Construct
  source 1..21: mol_type = other DNA
gtcatggtggactctgtgctt

SEQ ID NO: 40260 - DNA, 20 bp, synthetic construct
  misc_feature 1..20: note = Synthetic Construct
  source 1..20: mol_type = other DNA
ggtaagaacccggcctcaca

SEQ ID NO: 40261 - DNA, 24 bp, synthetic construct
  misc_feature 1..24: note = Synthetic Construct
  source 1..24: mol_type = other DNA
gaatattcctctcctgaccacgtt

SEQ ID NO: 40262 - DNA, 21 bp, synthetic construct
  misc_feature 1..21: note = Synthetic Construct
  source 1..21: mol_type = other DNA
gctaacgctggaacagacctt

SEQ ID NO: 40263 - DNA, 22 bp, synthetic construct
  misc_feature 1..22: note = Synthetic Construct
  source 1..22: mol_type = other DNA
cggtgttacactggctttggaa

SEQ ID NO: 40264 - DNA, 25 bp, synthetic construct
  misc_feature 1..25: note = Synthetic Construct
  source 1..25: mol_type = other DNA
gatgaaatcctaacagcgaggaaag

SEQ ID NO: 40265 - DNA, 22 bp, synthetic construct
  misc_feature 1..22: note = Synthetic Construct
  source 1..22: mol_type = other DNA
cgttcttcccgtggtggaaaca

SEQ ID NO: 40266 - DNA, 23 bp, synthetic construct
  misc_feature 1..23: note = Synthetic Construct
  source 1..23: mol_type = other DNA
cagtcctaaaggagtccgtgtca

SEQ ID NO: 40267 - DNA, 19 bp, synthetic construct
  misc_feature 1..19: note = Synthetic Construct
  source 1..19: mol_type = other DNA
tgctggcaaaagccacgta

SEQ ID NO: 40268 - DNA, 25 bp, synthetic construct
  misc_feature 1..25: note = Synthetic Construct
  source 1..25: mol_type = other DNA
gacatccaaaactgtgtggagagta

SEQ ID NO: 40269 - DNA, 20 bp, synthetic construct
  misc_feature 1..20: note = Synthetic Construct
  source 1..20: mol_type = other DNA
tgaaactggggcagccattg

SEQ ID NO: 40270 - DNA, 23 bp, synthetic construct
  misc_feature 1..23: note = Synthetic Construct
  source 1..23: mol_type = other DNA
agaatttcaagtgaggccctgaa

SEQ ID NO: 40271 - DNA, 19 bp, synthetic construct
  misc_feature 1..19: note = Synthetic Construct
  source 1..19: mol_type = other DNA
ggccacgtgacccctctta

SEQ ID NO: 40272 - DNA, 24 bp, synthetic construct
  misc_feature 1..24: note = Synthetic Construct
  source 1..24: mol_type = other DNA
gctgacttggtttcacctgtacta

SEQ ID NO: 40273 - DNA, 25 bp, synthetic construct
  misc_feature 1..25: note = Synthetic Construct
  source 1..25: mol_type = other DNA
gtgtgagaaggattctacccactgt

SEQ ID NO: 40274 - DNA, 23 bp, synthetic construct
  misc_feature 1..23: note = Synthetic Construct
  source 1..23: mol_type = other DNA
gctagaactactcaggggccttt

SEQ ID NO: 40275 - DNA, 23 bp, synthetic construct
  misc_feature 1..23: note = Synthetic Construct
  source 1..23: mol_type = other DNA
tgtctctgagatgagcctctgta

SEQ ID NO: 40276 - DNA, 23 bp, synthetic construct
  misc_feature 1..23: note = Synthetic Construct
  source 1..23: mol_type = other DNA
gggcttcatgtccacctcagaaa

SEQ ID NO: 40277 - DNA, 20 bp, synthetic construct
  misc_feature 1..20: note = Synthetic Construct
  source 1..20: mol_type = other DNA
agctcactcacgggctctgt

SEQ ID NO: 40278 - DNA, 21 bp, synthetic construct
  misc_feature 1..21: note = Synthetic Construct
  source 1..21: mol_type = other DNA
acgtgctgtctgtttgtcaga

SEQ ID NO: 40279 - DNA, 25 bp, synthetic construct
  misc_feature 1..25: note = Synthetic Construct
  source 1..25: mol_type = other DNA
ccctcatgcaaagcacttgctcaca

SEQ ID NO: 40280 - DNA, 20 bp, synthetic construct
  misc_feature 1..20: note = Synthetic Construct
  source 1..20: mol_type = other DNA
ttcctctggccctccctttt

SEQ ID NO: 40281 - DNA, 25 bp, synthetic construct
  misc_feature 1..25: note = Synthetic Construct
  source 1..25: mol_type = other DNA
tttggtttgactatgggccatttac

SEQ ID NO: 40282 - DNA, 20 bp, synthetic construct
  misc_feature 1..20: note = Synthetic Construct
  source 1..20: mol_type = other DNA
tagactggcagggagtgtgt

SEQ ID NO: 40283 - DNA, 18 bp, synthetic construct
  misc_feature 1..18: note = Synthetic Construct
  source 1..18: mol_type = other DNA
aggcaggggtcacaccaa

SEQ ID NO: 40284 - DNA, 24 bp, synthetic construct
  misc_feature 1..24: note = Synthetic Construct
  source 1..24: mol_type = other DNA
ccctgtggaatccctacattcaag

SEQ ID NO: 40285 - DNA, 19 bp, synthetic construct
  misc_feature 1..19: note = Synthetic Construct
  source 1..19: mol_type = other DNA
tggatggcgcttgctgact

SEQ ID NO: 40286 - DNA, 19 bp, synthetic construct
  misc_feature 1..19: note = Synthetic Construct
  source 1..19: mol_type = other DNA
acacggccatggcttcaca

SEQ ID NO: 40287 - DNA, 22 bp, synthetic construct
  misc_feature 1..22: note = Synthetic Construct
  source 1..22: mol_type = other DNA
ggcctgttaaccagcactggaa

SEQ ID NO: 40288 - DNA, 20 bp, synthetic construct
  misc_feature 1..20: note = Synthetic Construct
  source 1..20: mol_type = other DNA
agccagagcagctgaacagt

SEQ ID NO: 40289 - DNA, 19 bp, synthetic construct
  misc_feature 1..19: note = Synthetic Construct
  source 1..19: mol_type = other DNA
tgcctggacacgtggcttt

SEQ ID NO: 40290 - DNA, 26 bp, synthetic construct
  misc_feature 1..26: note = Synthetic Construct
  source 1..26: mol_type = other DNA
gagggaatgattagggaagttcatct

SEQ ID NO: 40291 - DNA, 21 bp, synthetic construct
  misc_feature 1..21: note = Synthetic Construct
  source 1..21: mol_type = other DNA
ctgatgtgcatggaggccaaa

SEQ ID NO: 40292 - DNA, 20 bp, synthetic construct
  misc_feature 1..20: note = Synthetic Construct
  source 1..20: mol_type = other DNA
gcagtgctggcaactggaaa

SEQ ID NO: 40293 - DNA, 19 bp, synthetic construct
  misc_feature 1..19: note = Synthetic Construct
  source 1..19: mol_type = other DNA
cctccctccagcaccatct

SEQ ID NO: 40294 - DNA, 27 bp, synthetic construct
  misc_feature 1..27: note = Synthetic Construct
  source 1..27: mol_type = other DNA
cctttgggtaaatatgaaggagcacaa

SEQ ID NO: 40295 - DNA, 25 bp, synthetic construct
  misc_feature 1..25: note = Synthetic Construct
  source 1..25: mol_type = other DNA
gtctcaggaaaacacgtgataccaa

SEQ ID NO: 40296 - DNA, 19 bp, synthetic construct
  misc_feature 1..19: note = Synthetic Construct
  source 1..19: mol_type = other DNA
ggggagctcaccaggaagt

SEQ ID NO: 40297 - DNA, 24 bp, synthetic construct
  misc_feature 1..24: note = Synthetic Construct
  source 1..24: mol_type = other DNA
ggcactgctcagattctccctgta

SEQ ID NO: 40298 - DNA, 20 bp, synthetic construct
  misc_feature 1..20: note = Synthetic Construct
  source 1..20: mol_type = other DNA
caaccctggttgctctgtca

SEQ ID NO: 40299 - DNA, 21 bp, synthetic construct
  misc_feature 1..21: note = Synthetic Construct
  source 1..21: mol_type = other DNA
tgtgctgctagcgaggggtat

SEQ ID NO: 40300 - DNA, 26 bp, synthetic construct
  misc_feature 1..26: note = Synthetic Construct
  source 1..26: mol_type = other DNA
cacaaattaggtagcctgtcctgtgt

SEQ ID NO: 40301 - DNA, 22 bp, synthetic construct
  misc_feature 1..22: note = Synthetic Construct
  source 1..22: mol_type = other DNA
acctccaggatgcaagccaaag

SEQ ID NO: 40302 - DNA, 22 bp, synthetic construct
  misc_feature 1..22: note = Synthetic Construct
  source 1..22: mol_type = other DNA
ggggacatctggggatgaatct

SEQ ID NO: 40303 - DNA, 22 bp, synthetic construct
  misc_feature 1..22: note = Synthetic Construct
  source 1..22: mol_type = other DNA
aggctccaacagcgataacttc

SEQ ID NO: 40304 - DNA, 20 bp, synthetic construct
  misc_feature 1..20: note = Synthetic Construct
  source 1..20: mol_type = other DNA
tcccaggaccagcctctact

SEQ ID NO: 40305 - DNA, 24 bp, synthetic construct
  misc_feature 1..24: note = Synthetic Construct
  source 1..24: mol_type = other DNA
gccctgattgctgtaacctagatg

SEQ ID NO: 40306 - DNA, 24 bp, synthetic construct
  misc_feature 1..24: note = Synthetic Construct
  source 1..24: mol_type = other DNA
gacttcagagccagctttttgcta

SEQ ID NO: 40307 - DNA, 28 bp, synthetic construct
  misc_feature 1..28: note = Synthetic Construct
  source 1..28: mol_type = other DNA
ccatgataggagttttgataggggttag

SEQ ID NO: 40308 - DNA, 29 bp, synthetic construct
  misc_feature 1..29: note = Synthetic Construct
  source 1..29: mol_type = other DNA
ggactaataggatggagagacaatcaact

SEQ ID NO: 40309 - DNA, 25 bp, synthetic construct
  misc_feature 1..25: note = Synthetic Construct
  source 1..25: mol_type = other DNA
tcatgtcatccctcttttccctact

SEQ ID NO: 40310 - DNA, 22 bp, synthetic construct
  misc_feature 1..22: note = Synthetic Construct
  source 1..22: mol_type = other DNA
tcaaccacacacttggccataa

SEQ ID NO: 40311 - DNA, 20 bp, synthetic construct
  misc_feature 1..20: note = Synthetic Construct
  source 1..20: mol_type = other DNA
tcccggtattcgtcgctaga

SEQ ID NO: 40312 - DNA, 21 bp, synthetic construct
  misc_feature 1..21: note = Synthetic Construct
  source 1..21: mol_type = other DNA
gctcaggtgaatgctgccaaa

SEQ ID NO: 40313 - DNA, 21 bp, synthetic construct
  misc_feature 1..21: note = Synthetic Construct
  source 1..21: mol_type = other DNA
gctgggcttgctgtgaaaaag

SEQ ID NO: 40314 - DNA, 21 bp, synthetic construct
  misc_feature 1..21: note = Synthetic Construct
  source 1..21: mol_type = other DNA
gactgggtgtgtggactttca

SEQ ID NO: 40315 - DNA, 22 bp, synthetic construct
  misc_feature 1..22: note = Synthetic Construct
  source 1..22: mol_type = other DNA
tgccaaggtcatcctcctaact

SEQ ID NO: 40316 - DNA, 23 bp, synthetic construct
  misc_feature 1..23: note = Synthetic Construct
  source 1..23: mol_type = other DNA
acattctgccaaggggacattta

SEQ ID NO: 40317 - DNA, 27 bp, synthetic construct
  misc_feature 1..27: note = Synthetic Construct
  source 1..27: mol_type = other DNA
ggctaacaggaaacctctaagacttta

SEQ ID NO: 40318 - DNA, 21 bp, synthetic construct
  misc_feature 1..21: note = Synthetic Construct
  source 1..21: mol_type = other DNA
gcagggctgggagtggtaaaa

SEQ ID NO: 40319 - DNA, 26 bp, synthetic construct
  misc_feature 1..26: note = Synthetic Construct
  source 1..26: mol_type = other DNA
ggagaatgtcctcacaaggtgtcagt

SEQ ID NO: 40320 - DNA, 21 bp, synthetic construct
  misc_feature 1..21: note = Synthetic Construct
  source 1..21: mol_type = other DNA
tggggaacactgcctgcagaa

SEQ ID NO: 40321 - DNA, 22 bp, synthetic construct
  misc_feature 1..22: note = Synthetic Construct
  source 1..22: mol_type = other DNA
cccagggtaaggggaggaacat

SEQ ID NO: 40322 - DNA, 20 bp, synthetic construct
  misc_feature 1..20: note = Synthetic Construct
  source 1..20: mol_type = other DNA
cagtgggtggcttcaggaat

SEQ ID NO: 40323 - DNA, 24 bp, synthetic construct
  misc_feature 1..24: note = Synthetic Construct
  source 1..24: mol_type = other DNA
gccctgtggttctaggatctgtct

SEQ ID NO: 40324 - DNA, 24 bp, synthetic construct
  misc_feature 1..24: note = Synthetic Construct
  source 1..24: mol_type = other DNA
gacctgatagcaaaactgctccta

SEQ ID NO: 40325 - DNA, 22 bp, synthetic construct
  misc_feature 1..22: note = Synthetic Construct
  source 1..22: mol_type = other DNA
cccatacgtgcaccaagcatac

SEQ ID NO: 40326 - DNA, 21 bp, synthetic construct
  misc_feature 1..21: note = Synthetic Construct
  source 1..21: mol_type = other DNA
cagggaaatcccagcttccat

SEQ ID NO: 40327 - DNA, 23 bp, synthetic construct
  misc_feature 1..23: note = Synthetic Construct
  source 1..23: mol_type = other DNA
gaaaccgatagctacccttgctt

SEQ ID NO: 40328 - DNA, 19 bp, synthetic construct
  misc_feature 1..19: note = Synthetic Construct
  source 1..19: mol_type = other DNA
accctcggctcctgctcta

SEQ ID NO: 40329 - DNA, 19 bp, synthetic construct
  misc_feature 1..19: note = Synthetic Construct
  source 1..19: mol_type = other DNA
cccctggactcctgctgat

SEQ ID NO: 40330 - DNA, 21 bp, synthetic construct
  misc_feature 1..21: note = Synthetic Construct
  source 1..21: mol_type = other DNA
ccctgcaaatactgcccttga

SEQ ID NO: 40331 - DNA, 21 bp, synthetic construct
  misc_feature 1..21: note = Synthetic Construct
  source 1..21: mol_type = other DNA
gggttgccagtggctgagaat

SEQ ID NO: 40332 - DNA, 20 bp, synthetic construct
  misc_feature 1..20: note = Synthetic Construct
  source 1..20: mol_type = other DNA
tgcagtgagggttcctgttg

SEQ ID NO: 40333 - DNA, 21 bp, synthetic construct
  misc_feature 1..21: note = Synthetic Construct
  source 1..21: mol_type = other DNA
tgcctgcttgactgtggtttc

SEQ ID NO: 40334 - DNA, 24 bp, synthetic construct
  misc_feature 1..24: note = Synthetic Construct
  source 1..24: mol_type = other DNA
caggtctctccttctggctaaatc

SEQ ID NO: 40335 - DNA, 25 bp, synthetic construct
  misc_feature 1..25: note = Synthetic Construct
  source 1..25: mol_type = other DNA
ctgcatcataaccatgtgaggtaga

SEQ ID NO: 40336 - DNA, 20 bp, synthetic construct
  misc_feature 1..20: note = Synthetic Construct
  source 1..20: mol_type = other DNA
cggcagccttcattctcaca

SEQ ID NO: 40337 - DNA, 24 bp, synthetic construct
  misc_feature 1..24: note = Synthetic Construct
  source 1..24: mol_type = other DNA
cagcttgagcttgagatcctttct

SEQ ID NO: 40338 - DNA, 23 bp, synthetic construct
  misc_feature 1..23: note = Synthetic Construct
  source 1..23: mol_type = other DNA
ggggaaactgcaccttgtatttg

SEQ ID NO: 40339 - DNA, 20 bp, synthetic construct
  misc_feature 1..20: note = Synthetic Construct
  source 1..20: mol_type = other DNA
tgctgctgatgggtccctaa

SEQ ID NO: 40340 - DNA, 24 bp, synthetic construct
  misc_feature 1..24: note = Synthetic Construct
  source 1..24: mol_type = other DNA
acttcaaagcagccattgtctgta

SEQ ID NO: 40341 - DNA, 26 bp, synthetic construct
  misc_feature 1..26: note = Synthetic Construct
  source 1..26: mol_type = other DNA
ctgtttcatggttgcaagctcatttg

SEQ ID NO: 40342 - DNA, 22 bp, synthetic construct
  misc_feature 1..22: note = Synthetic Construct
  source 1..22: mol_type = other DNA
ggggtctccttcttgagtctga

SEQ ID NO: 40343 - DNA, 21 bp, synthetic construct
  misc_feature 1..21: note = Synthetic Construct
  source 1..21: mol_type = other DNA
cctggagggatttcccacact

SEQ ID NO: 40344 - DNA, 24 bp, synthetic construct
  misc_feature 1..24: note = Synthetic Construct
  source 1..24: mol_type = other DNA
gtactcatccacctcgaagcttta

SEQ ID NO: 40345 - DNA, 22 bp, synthetic construct
  misc_feature 1..22: note = Synthetic Construct
  source 1..22: mol_type = other DNA
gcctgtgatggctttctgttga

SEQ ID NO: 40346 - DNA, 24 bp, synthetic construct
  misc_feature 1..24: note = Synthetic Construct
  source 1..24: mol_type = other DNA
gcagttcagtgctccagcctagat

SEQ ID NO: 40347 - DNA, 22 bp, synthetic construct
  misc_feature 1..22: note = Synthetic Construct
  source 1..22: mol_type = other DNA
gcctcaacagacagccagctaa

SEQ ID NO: 40348 - DNA, 22 bp, synthetic construct
  misc_feature 1..22: note = Synthetic Construct
  source 1..22: mol_type = other DNA
aatggttgagtccatccacgaa

SEQ ID NO: 40349 - DNA, 22 bp, synthetic construct
  misc_feature 1..22: note = Synthetic Construct
  source 1..22: mol_type = other DNA
actgaattccaccacccagaca

SEQ ID NO: 40350 - DNA, 22 bp, synthetic construct
  misc_feature 1..22: note = Synthetic Construct
  source 1..22: mol_type = other DNA
gacatgaggaccaccgtctatg

SEQ ID NO: 40351 - DNA, 22 bp, synthetic construct
  misc_feature 1..22: note = Synthetic Construct
  source 1..22: mol_type = other DNA
tggagaaatggaggcagaggtt

SEQ ID NO: 40352 - DNA, 25 bp, synthetic construct
  misc_feature 1..25: note = Synthetic Construct
  source 1..25: mol_type = other DNA
ggaactggatgctgtcacctctttc

SEQ ID NO: 40353 - DNA, 24 bp, synthetic construct
  misc_feature 1..24: note = Synthetic Construct
  source 1..24: mol_type = other DNA
gctcacactactgaggcgagatag

SEQ ID NO: 40354 - DNA, 22 bp, synthetic construct
  misc_feature 1..22: note = Synthetic Construct
  source 1..22: mol_type = other DNA
ctgctggtggatgtggtactga

SEQ ID NO: 40355 - DNA, 22 bp, synthetic construct
  misc_feature 1..22: note = Synthetic Construct
  source 1..22: mol_type = other DNA
gggaagggcttatctgccttag

SEQ ID NO: 40356 - DNA, 20 bp, synthetic construct
  misc_feature 1..20: note = Synthetic Construct
  source 1..20: mol_type = other DNA
aacccaaccaaagccgtgta

SEQ ID NO: 40357 - DNA, 24 bp, synthetic construct
  misc_feature 1..24: note = Synthetic Construct
  source 1..24: mol_type = other DNA
ccctgtctgtaggaccaggtttct

SEQ ID NO: 40358 - DNA, 28 bp, synthetic construct
  misc_feature 1..28: note = Synthetic Construct
  source 1..28: mol_type = other DNA
ggacagcaaaatacgccaatatcacaca

SEQ ID NO: 40359 - DNA, 26 bp, synthetic construct
  misc_feature 1..26: note = Synthetic Construct
  source 1..26: mol_type = other DNA
accccagtaaagatgtaatgctcaag

SEQ ID NO: 40360 - DNA, 24 bp, synthetic construct
  misc_feature 1..24: note = Synthetic Construct
  source 1..24: mol_type = other DNA
tggtaaagatcaccagaagcagtt

SEQ ID NO: 40361 - DNA, 18 bp, synthetic construct
  misc_feature 1..18: note = Synthetic Construct
  source 1..18: mol_type = other DNA
aaggcctgggcagtcaca

SEQ ID NO: 40362 - DNA, 18 bp, synthetic construct
  misc_feature 1..18: note = Synthetic Construct
  source 1..18: mol_type = other DNA
tggcagctggctgcaaat

SEQ ID NO: 40363 - DNA, 22 bp, synthetic construct
  misc_feature 1..22: note = Synthetic Construct
  source 1..22: mol_type = other DNA
gggctcctcccaaagtcatcaa

SEQ ID NO: 40364 - DNA, 25 bp, synthetic construct
  misc_feature 1..25: note = Synthetic Construct
  source 1..25: mol_type = other DNA
gcattttactaacccctacctgcat

SEQ ID NO: 40365 - DNA, 24 bp, synthetic construct
  misc_feature 1..24: note = Synthetic Construct
  source 1..24: mol_type = other DNA
ggccccgttggtgatatgatgaga

SEQ ID NO: 40366 - DNA, 27 bp, synthetic construct
  misc_feature 1..27: note = Synthetic Construct
  source 1..27: mol_type = other DNA
ggcctagaataacggttttaccctgaa

SEQ ID NO: 40367 - DNA, 21 bp, synthetic construct
  misc_feature 1..21: note = Synthetic Construct
  source 1..21: mol_type = other DNA
gtgagtcactggccaatctga

SEQ ID NO: 40368 - DNA, 23 bp, synthetic construct
  misc_feature 1..23: note = Synthetic Construct
  source 1..23: mol_type = other DNA
cacgagaaagccttgacaaacaa

SEQ ID NO: 40369 - DNA, 22 bp, synthetic construct
  misc_feature 1..22: note = Synthetic Construct
  source 1..22: mol_type = other DNA
ggcctgacaatgtttgcctctt

SEQ ID NO: 40370 - DNA, 24 bp, synthetic construct
  misc_feature 1..24: note = Synthetic Construct
  source 1..24: mol_type = other DNA
gcaagttgttcagagggtctggta

SEQ ID NO: 40371 - DNA, 22 bp, synthetic construct
  misc_feature 1..22: note = Synthetic Construct
  source 1..22: mol_type = other DNA
caccgggatcattgtcctgtct

SEQ ID NO: 40372 - DNA, 26 bp, synthetic construct
  misc_feature 1..26: note = Synthetic Construct
  source 1..26: mol_type = other DNA
gagaaggaatgactgtgggagaatag

SEQ ID NO: 40373 - DNA, 21 bp, synthetic construct
  misc_feature 1..21: note = Synthetic Construct
  source 1..21: mol_type = other DNA
tgtgtctcctcacccatgcta

SEQ ID NO: 40374 - DNA, 20 bp, synthetic construct
  misc_feature 1..20: note = Synthetic Construct
  source 1..20: mol_type = other DNA
ggtgtggcagcagaaacagt

SEQ ID NO: 40375 - DNA, 21 bp, synthetic construct
  misc_feature 1..21: note = Synthetic Construct
  source 1..21: mol_type = other DNA
gctgtcaacacctgtgcatct

SEQ ID NO: 40376 - DNA, 24 bp, synthetic construct
  misc_feature 1..24: note = Synthetic Construct
  source 1..24: mol_type = other DNA
tgaaacttcacagcctgcttacat

SEQ ID NO: 40377 - DNA, 26 bp, synthetic construct
  misc_feature 1..26: note = Synthetic Construct
  source 1..26: mol_type = other DNA
gtggatgatgtcatttctgagtctct

SEQ ID NO: 40378 - DNA, 21 bp, synthetic construct
  misc_feature 1..21: note = Synthetic Construct
  source 1..21: mol_type = other DNA
gggcctctcccttcactcatt

SEQ ID NO: 40379 - DNA, 21 bp, synthetic construct
  misc_feature 1..21: note = Synthetic Construct
  source 1..21: mol_type = other DNA
ggcttacactgcatggcaaag

SEQ ID NO: 40380 - DNA, 19 bp, synthetic construct
  misc_feature 1..19: note = Synthetic Construct
  source 1..19: mol_type = other DNA
tgggcttggcagggtgtag

SEQ ID NO: 40381 - DNA, 20 bp, synthetic construct
  misc_feature 1..20: note = Synthetic Construct
  source 1..20: mol_type = other DNA
agctggctggctgttgatga

SEQ ID NO: 40382 - DNA, 20 bp, synthetic construct
  misc_feature 1..20: note = Synthetic Construct
  source 1..20: mol_type = other DNA
acccacagggtgtcagactt

SEQ ID NO: 40383 - DNA, 22 bp, synthetic construct
  misc_feature 1..22: note = Synthetic Construct
  source 1..22: mol_type = other DNA
tcggggccctagatagtgaaag

SEQ ID NO: 40384 - DNA, 25 bp, synthetic construct
  misc_feature 1..25: note = Synthetic Construct
  source 1..25: mol_type = other DNA
gctgtcccagtgccatattgaccat

SEQ ID NO: 40385 - DNA, 21 bp, synthetic construct
  misc_feature 1..21: note = Synthetic Construct
  source 1..21: mol_type = other DNA
tggaaaccccacccaccttca

SEQ ID NO: 40386 - DNA, 23 bp, synthetic construct
  misc_feature 1..23: note = Synthetic Construct
  source 1..23: mol_type = other DNA
ccaaaggagtaatggtggtggaa

SEQ ID NO: 40387 - DNA, 18 bp, synthetic construct
  misc_feature 1..18: note = Synthetic Construct
  source 1..18: mol_type = other DNA
tggccagctcagggttga

SEQ ID NO: 40388 - DNA, 22 bp, synthetic construct
  misc_feature 1..22: note = Synthetic Construct
  source 1..22: mol_type = other DNA
ttgtgaggacagcagtctgttt

SEQ ID NO: 40389 - DNA, 20 bp, synthetic construct
  misc_feature 1..20: note = Synthetic Construct
  source 1..20: mol_type = other DNA
tggggctttccgtagactgt

SEQ ID NO: 40390 - DNA, 20 bp, synthetic construct
  misc_feature 1..20: note = Synthetic Construct
  source 1..20: mol_type = other DNA
agcaagggccaaagcacgaa

SEQ ID NO: 40391 - DNA, 25 bp, synthetic construct
  misc_feature 1..25: note = Synthetic Construct
  source 1..25: mol_type = other DNA
cagccacacttacttccatgctaca

SEQ ID NO: 40392 - DNA, 19 bp, synthetic construct
  misc_feature 1..19: note = Synthetic Construct
  source 1..19: mol_type = other DNA
ggggagggaggacacagaa

SEQ ID NO: 40393 - DNA, 27 bp, synthetic construct
  misc_feature 1..27: note = Synthetic Construct
  source 1..27: mol_type = other DNA
cacctggaaattgacagcttagacaga

SEQ ID NO: 40394 - DNA, 22 bp, synthetic construct
  misc_feature 1..22: note = Synthetic Construct
  source 1..22: mol_type = other DNA
ggaagagagcacctggagtttc

SEQ ID NO: 40395 - DNA, 20 bp, synthetic construct
  misc_feature 1..20: note = Synthetic Construct
  source 1..20: mol_type = other DNA
taagtcctcctgccgtggaa

SEQ ID NO: 40396 - DNA, 20 bp, synthetic construct
  misc_feature 1..20: note = Synthetic Construct
  source 1..20: mol_type = other DNA
agggtgctggcagagacaga

SEQ ID NO: 40397 - DNA, 25 bp, synthetic construct
  misc_feature 1..25: note = Synthetic Construct
  source 1..25: mol_type = other DNA
cactctttcttgggatgcaactatc

SEQ ID NO: 40398 - DNA, 21 bp, synthetic construct
  misc_feature 1..21: note = Synthetic Construct
  source 1..21: mol_type = other DNA
tgggtggaagtgtgtggatga

SEQ ID NO: 40399 - DNA, 19 bp, synthetic construct
  misc_feature 1..19: note = Synthetic Construct
  source 1..19: mol_type = other DNA
aaggggcaggacagcatct

SEQ ID NO: 40400 - DNA, 25 bp, synthetic construct
  misc_feature 1..25: note = Synthetic Construct
  source 1..25: mol_type = other DNA
ggaaggaagcatctccagacctctt

SEQ ID NO: 40401 - DNA, 26 bp, synthetic construct
  misc_feature 1..26: note = Synthetic Construct
  source 1..26: mol_type = other DNA
ccatggaggattcatgttccagtaga

SEQ ID NO: 40402 - DNA, 24 bp, synthetic construct
  misc_feature 1..24: note = Synthetic Construct
  source 1..24: mol_type = other DNA
cctgcttaaccctgggccatttac

SEQ ID NO: 40403 - DNA, 23 bp, synthetic construct
  misc_feature 1..23: note = Synthetic Construct
  source 1..23: mol_type = other DNA
aaggtcaactttcacctccatgt

SEQ ID NO: 40404 - DNA, 25 bp, synthetic construct
  misc_feature 1..25: note = Synthetic Construct
  source 1..25: mol_type = other DNA
gtgaggaagaaggaagagcgtatgt

SEQ ID NO: 40405 - DNA, 23 bp, synthetic construct
  misc_feature 1..23: note = Synthetic Construct
  source 1..23: mol_type = other DNA
ggaagggaagcctttcccagaat

SEQ ID NO: 40406 - DNA, 21 bp, synthetic construct
  misc_feature 1..21: note = Synthetic Construct
  source 1..21: mol_type = other DNA
ggctggctgtggtttcagagt

SEQ ID NO: 40407 - DNA, 22 bp, synthetic construct
  misc_feature 1..22: note = Synthetic Construct
  source 1..22: mol_type = other DNA
tgctcaccctctcactccaatg

SEQ ID NO: 40408 - DNA, 21 bp, synthetic construct
  misc_feature 1..21: note = Synthetic Construct
  source 1..21: mol_type = other DNA
cccaacccctgtgagacttca

SEQ ID NO: 40409 - DNA, 20 bp, synthetic construct
  misc_feature 1..20: note = Synthetic Construct
  source 1..20: mol_type = other DNA
aggttcaggcaaggggaagt

SEQ ID NO: 40410 - DNA, 24 bp, synthetic construct
  misc_feature 1..24: note = Synthetic Construct
  source 1..24: mol_type = other DNA
ttctgtcagcagaaggggattaag

SEQ ID NO: 40411 - DNA, 27 bp, synthetic construct
  misc_feature 1..27: note = Synthetic Construct
  source 1..27: mol_type = other DNA
cccaagtcttttccttctgggttcaag

SEQ ID NO: 40412 - DNA, 26 bp, synthetic construct
  misc_feature 1..26: note = Synthetic Construct
  source 1..26: mol_type = other DNA
gtatttcagttcctagtgccttcgta

SEQ ID NO: 40413 - DNA, 26 bp, synthetic construct
  misc_feature 1..26: note = Synthetic Construct
  source 1..26: mol_type = other DNA
gctccatctctgtagactttggctta

SEQ ID NO: 40414 - DNA, 22 bp, synthetic construct
  misc_feature 1..22: note = Synthetic Construct
  source 1..22: mol_type = other DNA
ctttgctggtcctctggttttg

SEQ ID NO: 40415 - DNA, 20 bp, synthetic construct
  misc_feature 1..20: note = Synthetic Construct
  source 1..20: mol_type = other DNA
cggggcagtgtacaggagta

SEQ ID NO: 40416 - DNA, 19 bp, synthetic construct
  misc_feature 1..19: note = Synthetic Construct
  source 1..19: mol_type = other DNA
tcctctgccctccctgcta

SEQ ID NO: 40417 - DNA, 21 bp, synthetic construct
  misc_feature 1..21: note = Synthetic Construct
  source 1..21: mol_type = other DNA
tccctgcactgctgctctcta

SEQ ID NO: 40418 - DNA, 24 bp, synthetic construct
  misc_feature 1..24: note = Synthetic Construct
  source 1..24: mol_type = other DNA
aagcaagagtggctctttcaattc

SEQ ID NO: 40419 - DNA, 23 bp, synthetic construct
  misc_feature 1..23: note = Synthetic Construct
  source 1..23: mol_type = other DNA
ccactctcgagaactacggtttc

SEQ ID NO: 40420 - DNA, 21 bp, synthetic construct
  misc_feature 1..21: note = Synthetic Construct
  source 1..21: mol_type = other DNA
tgcccagatactcggcaaatg

SEQ ID NO: 40421 - DNA, 24 bp, synthetic construct
  misc_feature 1..24: note = Synthetic Construct
  source 1..24: mol_type = other DNA
ggttggctgaaaaacctggttcaa

SEQ ID NO: 40422 - DNA, 20 bp, synthetic construct
  misc_feature 1..20: note = Synthetic Construct
  source 1..20: mol_type = other DNA
tggcttagggcccagaggat

SEQ ID NO: 40423 - DNA, 25 bp, synthetic construct
  misc_feature 1..25: note = Synthetic Construct
  source 1..25: mol_type = other DNA
gcaaaagctgtcaactccaccatag

SEQ ID NO: 40424 - DNA, 21 bp, synthetic construct
  misc_feature 1..21: note = Synthetic Construct
  source 1..21: mol_type = other DNA
tgccactgatggccactgttc

SEQ ID NO: 40425 - DNA, 23 bp, synthetic construct
  misc_feature 1..23: note = Synthetic Construct
  source 1..23: mol_type = other DNA
cccatctccacttttggagtctt

SEQ ID NO: 40426 - DNA, 20 bp, synthetic construct
  misc_feature 1..20: note = Synthetic Construct
  source 1..20: mol_type = other DNA
gctgcagtaagcaccagtga

SEQ ID NO: 40427 - DNA, 26 bp, synthetic construct
  misc_feature 1..26: note = Synthetic Construct
  source 1..26: mol_type = other DNA
acgagaacatccagagatacttgaga

SEQ ID NO: 40428 - DNA, 20 bp, synthetic construct
  misc_feature 1..20: note = Synthetic Construct
  source 1..20: mol_type = other DNA
gggccttgatttgccagagt

SEQ ID NO: 40429 - DNA, 21 bp, synthetic construct
  misc_feature 1..21: note = Synthetic Construct
  source 1..21: mol_type = other DNA
ttgccggaatgaggaggattg

SEQ ID NO: 40430 - DNA, 24 bp, synthetic construct
  misc_feature 1..24: note = Synthetic Construct
  source 1..24: mol_type = other DNA
ctctagcctttcagtccgtctttg

SEQ ID NO: 40431 - DNA, 25 bp, synthetic construct
  misc_feature 1..25: note = Synthetic Construct
  source 1..25: mol_type = other DNA
gacacacagataatgaaggcacaga

SEQ ID NO: 40432 - DNA, 22 bp, synthetic construct
  misc_feature 1..22: note = Synthetic Construct
  source 1..22: mol_type = other DNA
ccacgtggcgtatcttctgcat

SEQ ID NO: 40433 - DNA, 20 bp, synthetic construct
  misc_feature 1..20: note = Synthetic Construct
  source 1..20: mol_type = other DNA
cctcagctgtcagccagcaa

SEQ ID NO: 40434 - DNA, 23 bp, synthetic construct
  misc_feature 1..23: note = Synthetic Construct
  source 1..23: mol_type = other DNA
gcactaacgtagtaggccagaac

SEQ ID NO: 40435 - DNA, 26 bp, synthetic construct
  misc_feature 1..26: note = Synthetic Construct
  source 1..26: mol_type = other DNA
acactgatccttattgatggggaaac

SEQ ID NO: 40436 - DNA, 18 bp, synthetic construct
  misc_feature 1..18: note = Synthetic Construct
  source 1..18: mol_type = other DNA
acagcacggccaccattg

SEQ ID NO: 40437 - DNA, 20 bp, synthetic construct
  misc_feature 1..20: note = Synthetic Construct
  source 1..20: mol_type = other DNA
aagcatggcccgtgggtgaa

SEQ ID NO: 40438 - DNA, 20 bp, synthetic construct
  misc_feature 1..20: note = Synthetic Construct
  source 1..20: mol_type = other DNA
tggcctggcttcagggcata

SEQ ID NO: 40439 - DNA, 23 bp, synthetic construct
  misc_feature 1..23: note = Synthetic Construct
  source 1..23: mol_type = other DNA
acaaaagaatggaggcccacaga

SEQ ID NO: 40440 - DNA, 28 bp, synthetic construct
  misc_feature 1..28: note = Synthetic Construct
  source 1..28: mol_type = other DNA
gagctaagtgaagtatgagtgggattca

SEQ ID NO: 40441 - DNA, 24 bp, synthetic construct
  misc_feature 1..24: note = Synthetic Construct
  source 1..24: mol_type = other DNA
ggcttagagcactcctcagacaga

SEQ ID NO: 40442 - DNA, 21 bp, synthetic construct
  misc_feature 1..21: note = Synthetic Construct
  source 1..21: mol_type = other DNA
gccccttggccacatcttagt

SEQ ID NO: 40443 - DNA, 20 bp, synthetic construct
  misc_feature 1..20: note = Synthetic Construct
  source 1..20: mol_type = other DNA
accatatgccgggtgctact

SEQ ID NO: 40444 - DNA, 24 bp, synthetic construct
  misc_feature 1..24: note = Synthetic Construct
  source 1..24: mol_type = other DNA
ttttccttactgatcctgccacat

SEQ ID NO: 40445 - DNA, 23 bp, synthetic construct
  misc_feature 1..23: note = Synthetic Construct
  source 1..23: mol_type = other DNA
ggccagcacagtgattgtcctaa

SEQ ID NO: 40446 - DNA, 26 bp, synthetic construct
  misc_feature 1..26: note = Synthetic Construct
  source 1..26: mol_type = other DNA
ttgaatgggattctctaggaggagat

SEQ ID NO: 40447 - DNA, 22 bp, synthetic construct
  misc_feature 1..22: note = Synthetic Construct
  source 1..22: mol_type = other DNA
gctcaattcggaggagcaggtt

SEQ ID NO: 40448 - DNA, 20 bp, synthetic construct
  misc_feature 1..20: note = Synthetic Construct
  source 1..20: mol_type = other DNA
tggctgtggaatgcagttga

SEQ ID NO: 40449 - DNA, 21 bp, synthetic construct
  misc_feature 1..21: note = Synthetic Construct
  source 1..21: mol_type = other DNA
tggggagtgaagatgctgaac

SEQ ID NO: 40450 - DNA, 23 bp, synthetic construct
  misc_feature 1..23: note = Synthetic Construct
  source 1..23: mol_type = other DNA
gcccatggcaatcttggctaatg

SEQ ID NO: 40451 - DNA, 27 bp, synthetic construct
  misc_feature 1..27: note = Synthetic Construct
  source 1..27: mol_type = other DNA
cagctctgaatttggcccttctattct

SEQ ID NO: 40452 - DNA, 24 bp, synthetic construct
  misc_feature 1..24: note = Synthetic Construct
  source 1..24: mol_type = other DNA
ggagcaaacacgtggagaaacaac

SEQ ID NO: 40453 - DNA, 23 bp, synthetic construct
  misc_feature 1..23: note = Synthetic Construct
  source 1..23: mol_type = other DNA
ggcttgatcacagtgctgacttc

SEQ ID NO: 40454 - DNA, 18 bp, synthetic construct
  misc_feature 1..18: note = Synthetic Construct
  source 1..18: mol_type = other DNA
tcagggccacctggatgt

SEQ ID NO: 40455 - DNA, 23 bp, synthetic construct
  misc_feature 1..23: note = Synthetic Construct
  source 1..23: mol_type = other DNA
cgaagttatggctgggacaaatc

SEQ ID NO: 40456 - DNA, 23 bp, synthetic construct
  misc_feature 1..23: note = Synthetic Construct
  source 1..23: mol_type = other DNA
tgcagcacaaagtactgggattt

SEQ ID NO: 40457 - DNA, 20 bp, synthetic construct
  misc_feature 1..20: note = Synthetic Construct
  source 1..20: mol_type = other DNA
ggggtcctggggaggtatca

SEQ ID NO: 40458 - DNA, 25 bp, synthetic construct
  misc_feature 1..25: note = Synthetic Construct
  source 1..25: mol_type = other DNA
gccctccatgaaactcaatgacact

SEQ ID NO: 40459 - DNA, 29 bp, synthetic construct
  misc_feature 1..29: note = Synthetic Construct
  source 1..29: mol_type = other DNA
gccctttgaaaactgatcttgtactgcta

SEQ ID NO: 40460 - DNA, 24 bp, synthetic construct
  misc_feature 1..24: note = Synthetic Construct
  source 1..24: mol_type = other DNA
ggctgcttccctagaaagacaaca

SEQ ID NO: 40461 - DNA, 22 bp, synthetic construct
  misc_feature 1..22: note = Synthetic Construct
  source 1..22: mol_type = other DNA
tggacacccgtcaaggaggaaa

SEQ ID NO: 40462 - DNA, 18 bp, synthetic construct
  misc_feature 1..18: note = Synthetic Construct
  source 1..18: mol_type = other DNA
acgctgctgtgcctcaag

SEQ ID NO: 40463 - DNA, 22 bp, synthetic construct
  misc_feature 1..22: note = Synthetic Construct
  source 1..22: mol_type = other DNA
tggccaacagactgctgtcaac

SEQ ID NO: 40464 - DNA, 22 bp, synthetic construct
  misc_feature 1..22: note = Synthetic Construct
  source 1..22: mol_type = other DNA
ggacagcaaaggctgcttgact

SEQ ID NO: 40465 - DNA, 20 bp, synthetic construct
  misc_feature 1..20: note = Synthetic Construct
  source 1..20: mol_type = other DNA
gtgggatgcccaccttgttt

SEQ ID NO: 40466 - DNA, 20 bp, synthetic construct
  misc_feature 1..20: note = Synthetic Construct
  source 1..20: mol_type = other DNA
ccccatcagacaggcacctt

SEQ ID NO: 40467 - DNA, 24 bp, synthetic construct
  misc_feature 1..24: note = Synthetic Construct
  source 1..24: mol_type = other DNA
gcaagacacctgagatgctgatac

SEQ ID NO: 40468 - DNA, 20 bp, synthetic construct
  misc_feature 1..20: note = Synthetic Construct
  source 1..20: mol_type = other DNA
acagcatgggagccagtcat

SEQ ID NO: 40469 - DNA, 22 bp, synthetic construct
  misc_feature 1..22: note = Synthetic Construct
  source 1..22: mol_type = other DNA
cctgcagacagtgccttacctt

SEQ ID NO: 40470 - DNA, 25 bp, synthetic construct
  misc_feature 1..25: note = Synthetic Construct
  source 1..25: mol_type = other DNA
ggcatggtagactgagactggattg

SEQ ID NO: 40471 - DNA, 20 bp, synthetic construct
  misc_feature 1..20: note = Synthetic Construct
  source 1..20: mol_type = other DNA
ccttctgccccagcttcatc

SEQ ID NO: 40472 - DNA, 20 bp, synthetic construct
  misc_feature 1..20: note = Synthetic Construct
  source 1..20: mol_type = other DNA
gcgtgataggaagcgtgcat

SEQ ID NO: 40473 - DNA, 23 bp, synthetic construct
  misc_feature 1..23: note = Synthetic Construct
  source 1..23: mol_type = other DNA
agagagctttcacctcctggtta

SEQ ID NO: 40474 - DNA, 27 bp, synthetic construct
  misc_feature 1..27: note = Synthetic Construct
  source 1..27: mol_type = other DNA
gcttccgagaggttactgatacactga

SEQ ID NO: 40475 - DNA, 26 bp, synthetic construct
  misc_feature 1..26: note = Synthetic Construct
  source 1..26: mol_type = other DNA
ccaattgatccagtgagtgtggttag

SEQ ID NO: 40476 - DNA, 19 bp, synthetic construct
  misc_feature 1..19: note = Synthetic Construct
  source 1..19: mol_type = other DNA
cccaccatgtctggccatt

SEQ ID NO: 40477 - DNA, 20 bp, synthetic construct
  misc_feature 1..20: note = Synthetic Construct
  source 1..20: mol_type = other DNA
aggttcacgcagccttgttg

SEQ ID NO: 40478 - DNA, 19 bp, synthetic construct
  misc_feature 1..19: note = Synthetic Construct
  source 1..19: mol_type = other DNA
gggctccaaagtcgcgaaa

SEQ ID NO: 40479 - DNA, 23 bp, synthetic construct
  misc_feature 1..23: note = Synthetic Construct
  source 1..23: mol_type = other DNA
atccaatgaaactggagcaggaa

SEQ ID NO: 40480 - DNA, 21 bp, synthetic construct
  misc_feature 1..21: note = Synthetic Construct
  source 1..21: mol_type = other DNA
cggtgttcctggacatgtgtt

SEQ ID NO: 40481 - DNA, 20 bp, synthetic construct
  misc_feature 1..20: note = Synthetic Construct
  source 1..20: mol_type = other DNA
gtgggcaacaccgagagatg

SEQ ID NO: 40482 - DNA, 19 bp, synthetic construct
  misc_feature 1..19: note = Synthetic Construct
  source 1..19: mol_type = other DNA
cccacagcaccacgagctt

SEQ ID NO: 40483 - DNA, 20 bp, synthetic construct
  misc_feature 1..20: note = Synthetic Construct
  source 1..20: mol_type = other DNA
caaccgcttgcgatgcttct

SEQ ID NO: 40484 - DNA, 22 bp, synthetic construct
  misc_feature 1..22: note = Synthetic Construct
  source 1..22: mol_type = other DNA
ccttttccagcctctgaaggaa

SEQ ID NO: 40485 - DNA, 22 bp, synthetic construct
  misc_feature 1..22: note = Synthetic Construct
  source 1..22: mol_type = other DNA
tccacaggaaacctcccctgat

SEQ ID NO: 40486 - DNA, 22 bp, synthetic construct
  misc_feature 1..22: note = Synthetic Construct
  source 1..22: mol_type = other DNA
ctttagcagcagcagtggaaga

SEQ ID NO: 40487 - DNA, 23 bp, synthetic construct
  misc_feature 1..23: note = Synthetic Construct
  source 1..23: mol_type = other DNA
gaaggaagagccaacaggattgt

SEQ ID NO: 40488 - DNA, 25 bp, synthetic construct
  misc_feature 1..25: note = Synthetic Construct
  source 1..25: mol_type = other DNA
aatacccttccaccctgaattttct

SEQ ID NO: 40489 - DNA, 23 bp, synthetic construct
  misc_feature 1..23: note = Synthetic Construct
  source 1..23: mol_type = other DNA
cggagataccagctcactacgaa

SEQ ID NO: 40490 - DNA, 25 bp, synthetic construct
  misc_feature 1..25: note = Synthetic Construct
  source 1..25: mol_type = other DNA
gagagatgaccaggaacacatcttg

SEQ ID NO: 40491 - DNA, 20 bp, synthetic construct
  misc_feature 1..20: note = Synthetic Construct
  source 1..20: mol_type = other DNA
ggatgccctgcaactagcaa

SEQ ID NO: 40492 - DNA, 22 bp, synthetic construct
  misc_feature 1..22: note = Synthetic Construct
  source 1..22: mol_type = other DNA
ccccaaaccctctctgagattc

SEQ ID NO: 40493 - DNA, 20 bp, synthetic construct
  misc_feature 1..20: note = Synthetic Construct
  source 1..20: mol_type = other DNA
tgcagggtgcaacagactga

SEQ ID NO: 40494 - DNA, 21 bp, synthetic construct
  misc_feature 1..21: note = Synthetic Construct
  source 1..21: mol_type = other DNA
ctgtgaagcagtgggtgagat

SEQ ID NO: 40495 - DNA, 23 bp, synthetic construct
  misc_feature 1..23: note = Synthetic Construct
  source 1..23: mol_type = other DNA
catgtttggtgtgcaaaggatga

SEQ ID NO: 40496 - DNA, 21 bp, synthetic construct
  misc_feature 1..21: note = Synthetic Construct
  source 1..21: mol_type = other DNA
agttgtgttgggcctttccaa

SEQ ID NO: 40497 - DNA, 22 bp, synthetic construct
  misc_feature 1..22: note = Synthetic Construct
  source 1..22: mol_type = other DNA
tgacctgtctggtcccatgtag

SEQ ID NO: 40498 - DNA, 20 bp, synthetic construct
  misc_feature 1..20: note = Synthetic Construct
  source 1..20: mol_type = other DNA
ggaggtcagagacgcagaca

SEQ ID NO: 40499 - DNA, 23 bp, synthetic construct
  misc_feature 1..23: note = Synthetic Construct
  source 1..23: mol_type = other DNA
ggatgcacaagtttcaaggaaca

SEQ ID NO: 40500 - DNA, 25 bp, synthetic construct
  misc_feature 1..25: note = Synthetic Construct
  source 1..25: mol_type = other DNA
cacacttccttcaatgctgggatct

SEQ ID NO: 40501 - DNA, 25 bp, synthetic construct
  misc_feature 1..25: note = Synthetic Construct
  source 1..25: mol_type = other DNA
ggcaaatagacaaccgttcggtcaa

SEQ ID NO: 40502 - DNA, 20 bp, synthetic construct
  misc_feature 1..20: note = Synthetic Construct
  source 1..20: mol_type = other DNA
tcaggctactctgggtggtt

SEQ ID NO: 40503 - DNA, 26 bp, synthetic construct
  misc_feature 1..26: note = Synthetic Construct
  source 1..26: mol_type = other DNA
gtgtttgtccttctgtctgccaatag

SEQ ID NO: 40504 - DNA, 24 bp, synthetic construct
  misc_feature 1..24: note = Synthetic Construct
  source 1..24: mol_type = other DNA
ggcatccaagaagtttcccaggtt

SEQ ID NO: 40505 - DNA, 22 bp, synthetic construct
  misc_feature 1..22: note = Synthetic Construct
  source 1..22: mol_type = other DNA
ctccaacctctccctagtgctt

SEQ ID NO: 40506 - DNA, 25 bp, synthetic construct
  misc_feature 1..25: note = Synthetic Construct
  source 1..25: mol_type = other DNA
cccacttggttcggatttggagtag

SEQ ID NO: 40507 - DNA, 22 bp, synthetic construct
  misc_feature 1..22: note = Synthetic Construct
  source 1..22: mol_type = other DNA
gtgttgaaccccatcgggagaa

SEQ ID NO: 40508 - DNA, 19 bp, synthetic construct
  misc_feature 1..19: note = Synthetic Construct
  source 1..19: mol_type = other DNA
agcgctaggctctggaaga

SEQ ID NO: 40509 - DNA, 23 bp, synthetic construct
  misc_feature 1..23: note = Synthetic Construct
  source 1..23: mol_type = other DNA
tcagttggactcacaccgtatct

SEQ ID NO: 40510 - DNA, 24 bp, synthetic construct
  misc_feature 1..24: note = Synthetic Construct
  source 1..24: mol_type = other DNA
gggcacattccatcaacacctttg

SEQ ID NO: 40511 - DNA, 24 bp, synthetic construct
  misc_feature 1..24: note = Synthetic Construct
  source 1..24: mol_type = other DNA
cagtgttctctgttcctgcagatt

SEQ ID NO: 40512 - DNA, 27 bp, synthetic construct
  misc_feature 1..27: note = Synthetic Construct
  source 1..27: mol_type = other DNA
ctcatcctaatactgacctgtggttca

SEQ ID NO: 40513 - DNA, 25 bp, synthetic construct
  misc_feature 1..25: note = Synthetic Construct
  source 1..25: mol_type = other DNA
cccatagccagtcaaagatcaggtt

SEQ ID NO: 40514 - DNA, 23 bp, synthetic construct
  misc_feature 1..23: note = Synthetic Construct
  source 1..23: mol_type = other DNA
ctgaggagagaggctaactgaca

SEQ ID NO: 40515 - DNA, 22 bp, synthetic construct
  misc_feature 1..22: note = Synthetic Construct
  source 1..22: mol_type = other DNA
gggaaaagcccagtgtctgatg

SEQ ID NO: 40516 - DNA, 21 bp, synthetic construct
  misc_feature 1..21: note = Synthetic Construct
  source 1..21: mol_type = other DNA
tggcatttgcaaggggaacaa

SEQ ID NO: 40517 - DNA, 21 bp, synthetic construct
  misc_feature 1..21: note = Synthetic Construct
  source 1..21: mol_type = other DNA
agggaggaggcaaggacacaa

SEQ ID NO: 40518 - DNA, 19 bp, synthetic construct
  misc_feature 1..19: note = Synthetic Construct
  source 1..19: mol_type = other DNA
tgtggggcaccatgggttt

SEQ ID NO: 40519 - DNA, 23 bp, synthetic construct
  misc_feature 1..23: note = Synthetic Construct
  source 1..23: mol_type = other DNA
ccacccacaacaagcctcctatg

SEQ ID NO: 40520 - DNA, 20 bp, synthetic construct
  misc_feature 1..20: note = Synthetic Construct
  source 1..20: mol_type = other DNA
aaggaaggggcagaggttca

SEQ ID NO: 40521 - DNA, 23 bp, synthetic construct
  misc_feature 1..23: note = Synthetic Construct
  source 1..23: mol_type = other DNA
ccattgagcccaggtcatcatgt

SEQ ID NO: 40522 - DNA, 20 bp, synthetic construct
  misc_feature 1..20: note = Synthetic Construct
  source 1..20: mol_type = other DNA
ggggtgaaaggcacgagtaa

SEQ ID NO: 40523 - DNA, 19 bp, synthetic construct
  misc_feature 1..19: note = Synthetic Construct
  source 1..19: mol_type = other DNA
gcagtgacatggcctgcat

SEQ ID NO: 40524 - DNA, 24 bp, synthetic construct
  misc_feature 1..24: note = Synthetic Construct
  source 1..24: mol_type = other DNA
ccgagactcatccagtctgtcctt

SEQ ID NO: 40525 - DNA, 22 bp, synthetic construct
  misc_feature 1..22: note = Synthetic Construct
  source 1..22: mol_type = other DNA
agctcttctgcatccgccttag

SEQ ID NO: 40526 - DNA, 27 bp, synthetic construct
  misc_feature 1..27: note = Synthetic Construct
  source 1..27: mol_type = other DNA
cctactcgttaactcacattgacttct

SEQ ID NO: 40527 - DNA, 20 bp, synthetic construct
  misc_feature 1..20: note = Synthetic Construct
  source 1..20: mol_type = other DNA
acctgctgtgtacccctgaa

SEQ ID NO: 40528 - DNA, 20 bp, synthetic construct
  misc_feature 1..20: note = Synthetic Construct
  source 1..20: mol_type = other DNA
aggccacttgccatcccatt

SEQ ID NO: 40529 - DNA, 27 bp, synthetic construct
  misc_feature 1..27: note = Synthetic Construct
  source 1..27: mol_type = other DNA
cggcatcactaccatcttttctagagt

SEQ ID NO: 40530 - DNA, 20 bp, synthetic construct
  misc_feature 1..20: note = Synthetic Construct
  source 1..20: mol_type = other DNA
gccaccctggcctctgattc

SEQ ID NO: 40531 - DNA, 25 bp, synthetic construct
  misc_feature 1..25: note = Synthetic Construct
  source 1..25: mol_type = other DNA
gtggcagaaaagatgggttttgctt

SEQ ID NO: 40532 - DNA, 20 bp, synthetic construct
  misc_feature 1..20: note = Synthetic Construct
  source 1..20: mol_type = other DNA
gccctttccaggcacccatt

SEQ ID NO: 40533 - DNA, 25 bp, synthetic construct
  misc_feature 1..25: note = Synthetic Construct
  source 1..25: mol_type = other DNA
cctcccaagtcaacgaatgggtatc

SEQ ID NO: 40534 - DNA, 26 bp, synthetic construct
  misc_feature 1..26: note = Synthetic Construct
  source 1..26: mol_type = other DNA
gtgacaagttcaaatgactgcgttga

SEQ ID NO: 40535 - DNA, 20 bp, synthetic construct
  misc_feature 1..20: note = Synthetic Construct
  source 1..20: mol_type = other DNA
tcctgagcctgtgtccaagt

SEQ ID NO: 40536 - DNA, 19 bp, synthetic construct
  misc_feature 1..19: note = Synthetic Construct
  source 1..19: mol_type = other DNA
aggccacgctgggaacctt

SEQ ID NO: 40537 - DNA, 22 bp, synthetic construct
  misc_feature 1..22: note = Synthetic Construct
  source 1..22: mol_type = other DNA
cttcgtccttgcttcctgtttc

SEQ ID NO: 40538 - DNA, 22 bp, synthetic construct
  misc_feature 1..22: note = Synthetic Construct
  source 1..22: mol_type = other DNA
gctgtcacctttggctggaaag

SEQ ID NO: 40539 - DNA, 24 bp, synthetic construct
  misc_feature 1..24: note = Synthetic Construct
  source 1..24: mol_type = other DNA
caagacagatcctgagtggctaac

SEQ ID NO: 40540 - DNA, 20 bp, synthetic construct
  misc_feature 1..20: note = Synthetic Construct
  source 1..20: mol_type = other DNA
cctcactgcagcctcaaact

SEQ ID NO: 40541 - DNA, 20 bp, synthetic construct
  misc_feature 1..20: note = Synthetic Construct
  source 1..20: mol_type = other DNA
tgggtcccctctggcagtgt

SEQ ID NO: 40542 - DNA, 21 bp, synthetic construct
  misc_feature 1..21: note = Synthetic Construct
  source 1..21: mol_type = other DNA
aacgcttcagtggcttacact

SEQ ID NO: 40543 - DNA, 23 bp, synthetic construct
  misc_feature 1..23: note = Synthetic Construct
  source 1..23: mol_type = other DNA
tcccctccagagttccctctttg

SEQ ID NO: 40544 - DNA, 22 bp, synthetic construct
  misc_feature 1..22: note = Synthetic Construct
  source 1..22: mol_type = other DNA
gagctgaaaggcacaggacttg

SEQ ID NO: 40545 - DNA, 25 bp, synthetic construct
  misc_feature 1..25: note = Synthetic Construct
  source 1..25: mol_type = other DNA
aggaaatcaattgcttctcgtgact

SEQ ID NO: 40546 - DNA, 23 bp, synthetic construct
  misc_feature 1..23: note = Synthetic Construct
  source 1..23: mol_type = other DNA
tctgacttcccttgtctccaagt

SEQ ID NO: 40547 - DNA, 22 bp, synthetic construct
  misc_feature 1..22: note = Synthetic Construct
  source 1..22: mol_type = other DNA
ccaccacacgtggcctaaactt

SEQ ID NO: 40548 - DNA, 22 bp, synthetic construct
  misc_feature 1..22: note = Synthetic Construct
  source 1..22: mol_type = other DNA
cagttcaagcccagaggtgatg

SEQ ID NO: 40549 - DNA, 21 bp, synthetic construct
  misc_feature 1..21: note = Synthetic Construct
  source 1..21: mol_type = other DNA
tggccctgagcttgtcacttg

SEQ ID NO: 40550 - DNA, 22 bp, synthetic construct
  misc_feature 1..22: note = Synthetic Construct
  source 1..22: mol_type = other DNA
tgccttcctgtgtgggacagta

SEQ ID NO: 40551 - DNA, 20 bp, synthetic construct
  misc_feature 1..20: note = Synthetic Construct
  source 1..20: mol_type = other DNA
gctgcctgccttcaggtact

SEQ ID NO: 40552 - DNA, 25 bp, synthetic construct
  misc_feature 1..25: note = Synthetic Construct
  source 1..25: mol_type = other DNA
ttttggatgtgaagggactactgaa

SEQ ID NO: 40553 - DNA, 23 bp, synthetic construct
  misc_feature 1..23: note = Synthetic Construct
  source 1..23: mol_type = other DNA
gtctggcttgataggctccatct

SEQ ID NO: 40554 - DNA, 20 bp, synthetic construct
  misc_feature 1..20: note = Synthetic Construct
  source 1..20: mol_type = other DNA
tggggtgtgcatcagtgttc

SEQ ID NO: 40555 - DNA, 26 bp, synthetic construct
  misc_feature 1..26: note = Synthetic Construct
  source 1..26: mol_type = other DNA
ggcagattgatggagcaagtctccta

SEQ ID NO: 40556 - DNA, 21 bp, synthetic construct
  misc_feature 1..21: note = Synthetic Construct
  source 1..21: mol_type = other DNA
ggtgggcagcaggtgaaatct

SEQ ID NO: 40557 - DNA, 23 bp, synthetic construct
  misc_feature 1..23: note = Synthetic Construct
  source 1..23: mol_type = other DNA
gcaagctggagacgtaagagcta

SEQ ID NO: 40558 - DNA, 26 bp, synthetic construct
  misc_feature 1..26: note = Synthetic Construct
  source 1..26: mol_type = other DNA
cctaagacatgtaacgctttctgtga

SEQ ID NO: 40559 - DNA, 25 bp, synthetic construct
  misc_feature 1..25: note = Synthetic Construct
  source 1..25: mol_type = other DNA
cagggaaagcacacaatatgccatt

SEQ ID NO: 40560 - DNA, 24 bp, synthetic construct
  misc_feature 1..24: note = Synthetic Construct
  source 1..24: mol_type = other DNA
gtgcacagaatgggaaatggtgtt

SEQ ID NO: 40561 - DNA, 21 bp, synthetic construct
  misc_feature 1..21: note = Synthetic Construct
  source 1..21: mol_type = other DNA
tcctacacgtgggcctgacat

SEQ ID NO: 40562 - DNA, 24 bp, synthetic construct
  misc_feature 1..24: note = Synthetic Construct
  source 1..24: mol_type = other DNA
aggagatagaggcaaagacctgaa

SEQ ID NO: 40563 - DNA, 24 bp, synthetic construct
  misc_feature 1..24: note = Synthetic Construct
  source 1..24: mol_type = other DNA
cctgtactcagaaacgcagctaca

SEQ ID NO: 40564 - DNA, 18 bp, synthetic construct
  misc_feature 1..18: note = Synthetic Construct
  source 1..18: mol_type = other DNA
ggtggcaaagccgcacat

SEQ ID NO: 40565 - DNA, 23 bp, synthetic construct
  misc_feature 1..23: note = Synthetic Construct
  source 1..23: mol_type = other DNA
gggctatggagtcaggaaactgt

SEQ ID NO: 40566 - DNA, 27 bp, synthetic construct
  misc_feature 1..27: note = Synthetic Construct
  source 1..27: mol_type = other DNA
ggaggaaaaaggcttaggaagctgaag

SEQ ID NO: 40567 - DNA, 20 bp, synthetic construct
  misc_feature 1..20: note = Synthetic Construct
  source 1..20: mol_type = other DNA
tcctgtggttgcctccagat

SEQ ID NO: 40568 - DNA, 20 bp, synthetic construct
  misc_feature 1..20: note = Synthetic Construct
  source 1..20: mol_type = other DNA
tgccgattgcagacccacaa

SEQ ID NO: 40569 - DNA, 22 bp, synthetic construct
  misc_feature 1..22: note = Synthetic Construct
  source 1..22: mol_type = other DNA
gccttccaagtgagaagcaaag

SEQ ID NO: 40570 - DNA, 27 bp, synthetic construct
  misc_feature 1..27: note = Synthetic Construct
  source 1..27: mol_type = other DNA
acctcactatgacacactggttaaaag

SEQ ID NO: 40571 - DNA, 24 bp, synthetic construct
  misc_feature 1..24: note = Synthetic Construct
  source 1..24: mol_type = other DNA
gaatgttctgccatcttgggaaag

SEQ ID NO: 40572 - DNA, 30 bp, synthetic construct
  misc_feature 1..30: note = Synthetic Construct
  source 1..30: mol_type = other DNA
gggagacggaagttctcccttctataatac

SEQ ID NO: 40573 - DNA, 24 bp, synthetic construct
  misc_feature 1..24: note = Synthetic Construct
  source 1..24: mol_type = other DNA
tcttgaatgcattgccgtgtttac

SEQ ID NO: 40574 - DNA, 22 bp, synthetic construct
  misc_feature 1..22: note = Synthetic Construct
  source 1..22: mol_type = other DNA
ccagtgcagggtgccatttaca

SEQ ID NO: 40575 - DNA, 20 bp, synthetic construct
  misc_feature 1..20: note = Synthetic Construct
  source 1..20: mol_type = other DNA
cagagtccgagaggcacaga

SEQ ID NO: 40576 - DNA, 29 bp, synthetic construct
  misc_feature 1..29: note = Synthetic Construct
  source 1..29: mol_type = other DNA
ccatacctcctttactggatagtgagttc

SEQ ID NO: 40577 - DNA, 22 bp, synthetic construct
  misc_feature 1..22: note = Synthetic Construct
  source 1..22: mol_type = other DNA
tgccttgacctccccattctga

SEQ ID NO: 40578 - DNA, 22 bp, synthetic construct
  misc_feature 1..22: note = Synthetic Construct
  source 1..22: mol_type = other DNA
ctgcagaaatgcccaggagttg

SEQ ID NO: 40579 - DNA, 29 bp, synthetic construct
  misc_feature 1..29: note = Synthetic Construct
  source 1..29: mol_type = other DNA
gggttaggtgactctaggagtatagtaag

SEQ ID NO: 40580 - DNA, 25 bp, synthetic construct
  misc_feature 1..25: note = Synthetic Construct
  source 1..25: mol_type = other DNA
gcccctcaatttgctatgagcttgt

SEQ ID NO: 40581 - DNA, 20 bp, synthetic construct
  misc_feature 1..20: note = Synthetic Construct
  source 1..20: mol_type = other DNA
tggcaacgacgggtagtaag

SEQ ID NO: 40582 - DNA, 23 bp, synthetic construct
  misc_feature 1..23: note = Synthetic Construct
  source 1..23: mol_type = other DNA
actgtcttgtgaccaggagagta

SEQ ID NO: 40583 - DNA, 22 bp, synthetic construct
  misc_feature 1..22: note = Synthetic Construct
  source 1..22: mol_type = other DNA
cgcattcaggggcacttccaaa

SEQ ID NO: 40584 - DNA, 24 bp, synthetic construct
  misc_feature 1..24: note = Synthetic Construct
  source 1..24: mol_type = other DNA
ttctctgacaaagactgggaaaca

SEQ ID NO: 40585 - DNA, 22 bp, synthetic construct
  misc_feature 1..22: note = Synthetic Construct
  source 1..22: mol_type = other DNA
gttccttgcagcagtgacaaga

SEQ ID NO: 40586 - DNA, 20 bp, synthetic construct
  misc_feature 1..20: note = Synthetic Construct
  source 1..20: mol_type = other DNA
tggttggcagcacacagtga

SEQ ID NO: 40587 - DNA, 24 bp, synthetic construct
  misc_feature 1..24: note = Synthetic Construct
  source 1..24: mol_type = other DNA
ggaggcatctcacttcctcctgaa

SEQ ID NO: 40588 - DNA, 28 bp, synthetic construct
  misc_feature 1..28: note = Synthetic Construct
  source 1..28: mol_type = other DNA
caccctacaactagatggaaccctaatc

SEQ ID NO: 40589 - DNA, 29 bp, synthetic construct
  misc_feature 1..29: note = Synthetic Construct
  source 1..29: mol_type = other DNA
gcatccctattactgtcttagctgtcaga

SEQ ID NO: 40590 - DNA, 21 bp, synthetic construct
  misc_feature 1..21: note = Synthetic Construct
  source 1..21: mol_type = other DNA
gagagtttgggcactggtgat

SEQ ID NO: 40591 - DNA, 21 bp, synthetic construct
  misc_feature 1..21: note = Synthetic Construct
  source 1..21: mol_type = other DNA
gcctccagggtgctactctca

SEQ ID NO: 40592 - DNA, 22 bp, synthetic construct
  misc_feature 1..22: note = Synthetic Construct
  source 1..22: mol_type = other DNA
tcatctctcccctctcaacgaa

SEQ ID NO: 40593 - DNA, 27 bp, synthetic construct
  misc_feature 1..27: note = Synthetic Construct
  source 1..27: mol_type = other DNA
actttcacagtcaccatttctggatag

SEQ ID NO: 40594 - DNA, 26 bp, synthetic construct
  misc_feature 1..26: note = Synthetic Construct
  source 1..26: mol_type = other DNA
gctgagctttcgttttgacccagaag

SEQ ID NO: 40595 - DNA, 24 bp, synthetic construct
  misc_feature 1..24: note = Synthetic Construct
  source 1..24: mol_type = other DNA
agccagattgcagtgaattgaaga

SEQ ID NO: 40596 - DNA, 20 bp, synthetic construct
  misc_feature 1..20: note = Synthetic Construct
  source 1..20: mol_type = other DNA
gtagtggtggcagtggcaaa

SEQ ID NO: 40597 - DNA, 21 bp, synthetic construct
  misc_feature 1..21: note = Synthetic Construct
  source 1..21: mol_type = other DNA
ctgcctcattccaaggtctgt

SEQ ID NO: 40598 - DNA, 25 bp, synthetic construct
  misc_feature 1..25: note = Synthetic Construct
  source 1..25: mol_type = other DNA
gagggaagagagtagtccaggttat

SEQ ID NO: 40599 - DNA, 23 bp, synthetic construct
  misc_feature 1..23: note = Synthetic Construct
  source 1..23: mol_type = other DNA
ggtttggacaccatgcttcactt

SEQ ID NO: 40600 - DNA, 23 bp, synthetic construct
  misc_feature 1..23: note = Synthetic Construct
  source 1..23: mol_type = other DNA
gaactttgctggggagatgtctt

SEQ ID NO: 40601 - DNA, 20 bp, synthetic construct
  misc_feature 1..20: note = Synthetic Construct
  source 1..20: mol_type = other DNA
cagccaagagcatggcagaa

SEQ ID NO: 40602 - DNA, 22 bp, synthetic construct
  misc_feature 1..22: note = Synthetic Construct
  source 1..22: mol_type = other DNA
gggcatacggacctaagtggtt

SEQ ID NO: 40603 - DNA, 25 bp, synthetic construct
  misc_feature 1..25: note = Synthetic Construct
  source 1..25: mol_type = other DNA
caggtttgggtttatcagcatgtag

SEQ ID NO: 40604 - DNA, 20 bp, synthetic construct
  misc_feature 1..20: note = Synthetic Construct
  source 1..20: mol_type = other DNA
tgtcctgactcctgcccatt

SEQ ID NO: 40605 - DNA, 21 bp, synthetic construct
  misc_feature 1..21: note = Synthetic Construct
  source 1..21: mol_type = other DNA
tgcctccagctagaccggaaa

SEQ ID NO: 40606 - DNA, 23 bp, synthetic construct
  misc_feature 1..23: note = Synthetic Construct
  source 1..23: mol_type = other DNA
cccttctgaccattgctgctcaa

SEQ ID NO: 40607 - DNA, 22 bp, synthetic construct
  misc_feature 1..22: note = Synthetic Construct
  source 1..22: mol_type = other DNA
caaggactttggctccctttct

SEQ ID NO: 40608 - DNA, 23 bp, synthetic construct
  misc_feature 1..23: note = Synthetic Construct
  source 1..23: mol_type = other DNA
tcatcttctcaaggaggcctttc

SEQ ID NO: 40609 - DNA, 21 bp, synthetic construct
  misc_feature 1..21: note = Synthetic Construct
  source 1..21: mol_type = other DNA
actgagcctggccctgttgta

SEQ ID NO: 40610 - DNA, 20 bp, synthetic construct
  misc_feature 1..20: note = Synthetic Construct
  source 1..20: mol_type = other DNA
agagcccttggggctacact

SEQ ID NO: 40611 - DNA, 24 bp, synthetic construct
  misc_feature 1..24: note = Synthetic Construct
  source 1..24: mol_type = other DNA
ggagaaccactgaagctttggaat

SEQ ID NO: 40612 - DNA, 21 bp, synthetic construct
  misc_feature 1..21: note = Synthetic Construct
  source 1..21: mol_type = other DNA
gagcagcccttgttcatggat

SEQ ID NO: 40613 - DNA, 23 bp, synthetic construct
  misc_feature 1..23: note = Synthetic Construct
  source 1..23: mol_type = other DNA
gaaagtgaccagatgcccatgat

SEQ ID NO: 40614 - DNA, 24 bp, synthetic construct
  misc_feature 1..24: note = Synthetic Construct
  source 1..24: mol_type = other DNA
tggtgatgagtatgagaggctgat

SEQ ID NO: 40615 - DNA, 25 bp, synthetic construct
  misc_feature 1..25: note = Synthetic Construct
  source 1..25: mol_type = other DNA
gtgtgtgtagagttccctcggttac

SEQ ID NO: 40616 - DNA, 21 bp, synthetic construct
  misc_feature 1..21: note = Synthetic Construct
  source 1..21: mol_type = other DNA
tagcacccacacggggatcaa

SEQ ID NO: 40617 - DNA, 24 bp, synthetic construct
  misc_feature 1..24: note = Synthetic Construct
  source 1..24: mol_type = other DNA
ctgaggacagacacccagagatag

SEQ ID NO: 40618 - DNA, 22 bp, synthetic construct
  misc_feature 1..22: note = Synthetic Construct
  source 1..22: mol_type = other DNA
ccttgtcagggtttcgccaaca

SEQ ID NO: 40619 - DNA, 22 bp, synthetic construct
  misc_feature 1..22: note = Synthetic Construct
  source 1..22: mol_type = other DNA
cgtgactgccctgaccatcttt

SEQ ID NO: 40620 - DNA, 19 bp, synthetic construct
  misc_feature 1..19: note = Synthetic Construct
  source 1..19: mol_type = other DNA
ggcctgggtaccagtcctt

SEQ ID NO: 40621 - DNA, 21 bp, synthetic construct
  misc_feature 1..21: note = Synthetic Construct
  source 1..21: mol_type = other DNA
attgccctgcttggggcaaga

SEQ ID NO: 40622 - DNA, 20 bp, synthetic construct
  misc_feature 1..20: note = Synthetic Construct
  source 1..20: mol_type = other DNA
tcgtgccacagggtgactga

SEQ ID NO: 40623 - DNA, 22 bp, synthetic construct
  misc_feature 1..22: note = Synthetic Construct
  source 1..22: mol_type = other DNA
aagcctgctttcctaggagttg

SEQ ID NO: 40624 - DNA, 23 bp, synthetic construct
  misc_feature 1..23: note = Synthetic Construct
  source 1..23: mol_type = other DNA
agtgaagattgggcatggttaca

SEQ ID NO: 40625 - DNA, 18 bp, synthetic construct
  misc_feature 1..18: note = Synthetic Construct
  source 1..18: mol_type = other DNA
tcacggtcctgcctcact

SEQ ID NO: 40626 - DNA, 22 bp, synthetic construct
  misc_feature 1..22: note = Synthetic Construct
  source 1..22: mol_type = other DNA
tacccctcctgggaggaaccaa

SEQ ID NO: 40627 - DNA, 25 bp, synthetic construct
  misc_feature 1..25: note = Synthetic Construct
  source 1..25: mol_type = other DNA
cagaaggaagctaccagtatcacaa

SEQ ID NO: 40628 - DNA, 26 bp, synthetic construct
  misc_feature 1..26: note = Synthetic Construct
  source 1..26: mol_type = other DNA
ctgcagttggatcagaagtggtattc

SEQ ID NO: 40629 - DNA, 23 bp, synthetic construct
  misc_feature 1..23: note = Synthetic Construct
  source 1..23: mol_type = other DNA
ggcctgattcatgtctgctgcta

SEQ ID NO: 40630 - DNA, 26 bp, synthetic construct
  misc_feature 1..26: note = Synthetic Construct
  source 1..26: mol_type = other DNA
cactgaactagttggtttctcacaca

SEQ ID NO: 40631 - DNA, 23 bp, synthetic construct
  misc_feature 1..23: note = Synthetic Construct
  source 1..23: mol_type = other DNA
agcaatggaaaacacctccatgt

SEQ ID NO: 40632 - DNA, 24 bp, synthetic construct
  misc_feature 1..24: note = Synthetic Construct
  source 1..24: mol_type = other DNA
tgcaaacatctttggaagggatct

SEQ ID NO: 40633 - DNA, 26 bp, synthetic construct
  misc_feature 1..26: note = Synthetic Construct
  source 1..26: mol_type = other DNA
ggatctagtgattgttaggccaggtt

SEQ ID NO: 40634 - DNA, 23 bp, synthetic construct
  misc_feature 1..23: note = Synthetic Construct
  source 1..23: mol_type = other DNA
ccccacaagtaggaggctgtagt

SEQ ID NO: 40635 - DNA, 24 bp, synthetic construct
  misc_feature 1..24: note = Synthetic Construct
  source 1..24: mol_type = other DNA
tcaaaacagcttggtaacccacat

SEQ ID NO: 40636 - DNA, 25 bp, synthetic construct
  misc_feature 1..25: note = Synthetic Construct
  source 1..25: mol_type = other DNA
ggaatgtccactccataaccacaca

SEQ ID NO: 40637 - DNA, 21 bp, synthetic construct
  misc_feature 1..21: note = Synthetic Construct
  source 1..21: mol_type = other DNA
gcccgagggagagattgaaga

SEQ ID NO: 40638 - DNA, 24 bp, synthetic construct
  misc_feature 1..24: note = Synthetic Construct
  source 1..24: mol_type = other DNA
ccgtagcctgggaggaatgtttac

SEQ ID NO: 40639 - DNA, 24 bp, synthetic construct
  misc_feature 1..24: note = Synthetic Construct
  source 1..24: mol_type = other DNA
ccattgcagaaactcgctatcctt

SEQ ID NO: 40640 - DNA, 22 bp, synthetic construct
  misc_feature 1..22: note = Synthetic Construct
  source 1..22: mol_type = other DNA
gtcagctactgggcaagaggaa

SEQ ID NO: 40641 - DNA, 23 bp, synthetic construct
  misc_feature 1..23: note = Synthetic Construct
  source 1..23: mol_type = other DNA
gtctcagctgtcttagcgtcaca

SEQ ID NO: 40642 - DNA, 20 bp, synthetic construct
  misc_feature 1..20: note = Synthetic Construct
  source 1..20: mol_type = other DNA
tctcgctctgacctcaccat

SEQ ID NO: 40643 - DNA, 20 bp, synthetic construct
  misc_feature 1..20: note = Synthetic Construct
  source 1..20: mol_type = other DNA
tggtgacgggagttggaatg

SEQ ID NO: 40644 - DNA, 23 bp, synthetic construct
  misc_feature 1..23: note = Synthetic Construct
  source 1..23: mol_type = other DNA
ccatttcagccatctaccactgt

SEQ ID NO: 40645 - DNA, 22 bp, synthetic construct
  misc_feature 1..22: note = Synthetic Construct
  source 1..22: mol_type = other DNA
ccaacctcagaggggcaaattc

SEQ ID NO: 40646 - DNA, 22 bp, synthetic construct
  misc_feature 1..22: note = Synthetic Construct
  source 1..22: mol_type = other DNA
gttccctggaggtatccgaatg

SEQ ID NO: 40647 - DNA, 18 bp, synthetic construct
  misc_feature 1..18: note = Synthetic Construct
  source 1..18: mol_type = other DNA
ccttggcccgcctcaaaa

SEQ ID NO: 40648 - DNA, 22 bp, synthetic construct
  misc_feature 1..22: note = Synthetic Construct
  source 1..22: mol_type = other DNA
ggcatggctgtgacttgctttg

SEQ ID NO: 40649 - DNA, 25 bp, synthetic construct
  misc_feature 1..25: note = Synthetic Construct
  source 1..25: mol_type = other DNA
cacactgaaaataaaagggcggaaa

SEQ ID NO: 40650 - DNA, 22 bp, synthetic construct
  misc_feature 1..22: note = Synthetic Construct
  source 1..22: mol_type = other DNA
cggaatgaggatggcagttaca

SEQ ID NO: 40651 - DNA, 21 bp, synthetic construct
  misc_feature 1..21: note = Synthetic Construct
  source 1..21: mol_type = other DNA
gcctgtgccatcacgcttaga

SEQ ID NO: 40652 - DNA, 22 bp, synthetic construct
  misc_feature 1..22: note = Synthetic Construct
  source 1..22: mol_type = other DNA
acaaggaagctgtcactggttt

SEQ ID NO: 40653 - DNA, 20 bp, synthetic construct
  misc_feature 1..20: note = Synthetic Construct
  source 1..20: mol_type = other DNA
aggagcacggctgtgaagat

SEQ ID NO: 40654 - DNA, 24 bp, synthetic construct
  misc_feature 1..24: note = Synthetic Construct
  source 1..24: mol_type = other DNA
gctagaggatcgctaggtggttac

SEQ ID NO: 40655 - DNA, 23 bp, synthetic construct
  misc_feature 1..23: note = Synthetic Construct
  source 1..23: mol_type = other DNA
gctccgggcttcagttttaggta

SEQ ID NO: 40656 - DNA, 20 bp, synthetic construct
  misc_feature 1..20: note = Synthetic Construct
  source 1..20: mol_type = other DNA
agggttacgggcagagaact

SEQ ID NO: 40657 - DNA, 20 bp, synthetic construct
  misc_feature 1..20: note = Synthetic Construct
  source 1..20: mol_type = other DNA
ccctctccaccctcctcaga

SEQ ID NO: 40658 - DNA, 23 bp, synthetic construct
  misc_feature 1..23: note = Synthetic Construct
  source 1..23: mol_type = other DNA
gtgtgaatgccctcagtcaggtt

SEQ ID NO: 40659 - DNA, 18 bp, synthetic construct
  misc_feature 1..18: note = Synthetic Construct
  source 1..18: mol_type = other DNA
acacagtgctggctgcaa

SEQ ID NO: 40660 - DNA, 25 bp, synthetic construct
  misc_feature 1..25: note = Synthetic Construct
  source 1..25: mol_type = other DNA
gaagctcttacccctaactcgattg

SEQ ID NO: 40661 - DNA, 22 bp, synthetic construct
  misc_feature 1..22: note = Synthetic Construct
  source 1..22: mol_type = other DNA
tgatgggcttcctgggaggtaa

SEQ ID NO: 40662 - DNA, 22 bp, synthetic construct
  misc_feature 1..22: note = Synthetic Construct
  source 1..22: mol_type = other DNA
tggttgactgccagacctcaga

SEQ ID NO: 40663 - DNA, 20 bp, synthetic construct
  misc_feature 1..20: note = Synthetic Construct
  source 1..20: mol_type = other DNA
tcttggcagacagggagact

SEQ ID NO: 40664 - DNA, 19 bp, synthetic construct
  misc_feature 1..19: note = Synthetic Construct
  source 1..19: mol_type = other DNA
gcagcttgctgccacacaa

SEQ ID NO: 40665 - DNA, 21 bp, synthetic construct
  misc_feature 1..21: note = Synthetic Construct
  source 1..21: mol_type = other DNA
tgagggcctgctaggatcttg

SEQ ID NO: 40666 - DNA, 24 bp, synthetic construct
  misc_feature 1..24: note = Synthetic Construct
  source 1..24: mol_type = other DNA
gcagtcgccaacttctgggtttag

SEQ ID NO: 40667 - DNA, 20 bp, synthetic construct
  misc_feature 1..20: note = Synthetic Construct
  source 1..20: mol_type = other DNA
gtcaaagctggcctgcatca

SEQ ID NO: 40668 - DNA, 20 bp, synthetic construct
  misc_feature 1..20: note = Synthetic Construct
  source 1..20: mol_type = other DNA
actgctgccctctgctggat

SEQ ID NO: 40669 - DNA, 22 bp, synthetic construct
  misc_feature 1..22: note = Synthetic Construct
  source 1..22: mol_type = other DNA
cctctccaaccccaaagtctgt

SEQ ID NO: 40670 - DNA, 21 bp, synthetic construct
  misc_feature 1..21: note = Synthetic Construct
  source 1..21: mol_type = other DNA
tggtcttgccctctggagcat

SEQ ID NO: 40671 - DNA, 23 bp, synthetic construct
  misc_feature 1..23: note = Synthetic Construct
  source 1..23: mol_type = other DNA
ggcttagaaggattccagcaact

SEQ ID NO: 40672 - DNA, 20 bp, synthetic construct
  misc_feature 1..20: note = Synthetic Construct
  source 1..20: mol_type = other DNA
gcaaggagcacatcgcttgt

SEQ ID NO: 40673 - DNA, 20 bp, synthetic construct
  misc_feature 1..20: note = Synthetic Construct
  source 1..20: mol_type = other DNA
tgtgagtgcagagggcatgt

SEQ ID NO: 40674 - DNA, 22 bp, synthetic construct
  misc_feature 1..22: note = Synthetic Construct
  source 1..22: mol_type = other DNA
acttccgggtagtgggtctgtt

SEQ ID NO: 40675 - DNA, 22 bp, synthetic construct
  misc_feature 1..22: note = Synthetic Construct
  source 1..22: mol_type = other DNA
gggtttcacgtgggaaggcaaa

SEQ ID NO: 40676 - DNA, 25 bp, synthetic construct
  misc_feature 1..25: note = Synthetic Construct
  source 1..25: mol_type = other DNA
aggactagctgtgtaccagaatctt

SEQ ID NO: 40677 - DNA, 22 bp, synthetic construct
  misc_feature 1..22: note = Synthetic Construct
  source 1..22: mol_type = other DNA
cagcttactggctgtcctgaga

SEQ ID NO: 40678 - DNA, 22 bp, synthetic construct
  misc_feature 1..22: note = Synthetic Construct
  source 1..22: mol_type = other DNA
cccaaccagggatatccagact

SEQ ID NO: 40679 - DNA, 22 bp, synthetic construct
  misc_feature 1..22: note = Synthetic Construct
  source 1..22: mol_type = other DNA
ccatcacagcctgtccatctca

SEQ ID NO: 40680 - DNA, 20 bp, synthetic construct
  misc_feature 1..20: note = Synthetic Construct
  source 1..20: mol_type = other DNA
cacagaggccgagtcaaaca

SEQ ID NO: 40681 - DNA, 23 bp, synthetic construct
  misc_feature 1..23: note = Synthetic Construct
  source 1..23: mol_type = other DNA
ggaaggggcagcagtttatcctt

SEQ ID NO: 40682 - DNA, 20 bp, synthetic construct
  misc_feature 1..20: note = Synthetic Construct
  source 1..20: mol_type = other DNA
tggggaaagtgctgccaaag

SEQ ID NO: 40683 - DNA, 28 bp, synthetic construct
  misc_feature 1..28: note = Synthetic Construct
  source 1..28: mol_type = other DNA
gggtcaatcgttggcattatctgaggaa

SEQ ID NO: 40684 - DNA, 21 bp, synthetic construct
  misc_feature 1..21: note = Synthetic Construct
  source 1..21: mol_type = other DNA
ttaccacctcgccccttgagt

SEQ ID NO: 40685 - DNA, 25 bp, synthetic construct
  misc_feature 1..25: note = Synthetic Construct
  source 1..25: mol_type = other DNA
catttcataccttgcacttccagtt

SEQ ID NO: 40686 - DNA, 25 bp, synthetic construct
  misc_feature 1..25: note = Synthetic Construct
  source 1..25: mol_type = other DNA
ccagccactaattttccaccctgat

SEQ ID NO: 40687 - DNA, 24 bp, synthetic construct
  misc_feature 1..24: note = Synthetic Construct
  source 1..24: mol_type = other DNA
ccatgtctgtcatccctgaattgt

SEQ ID NO: 40688 - DNA, 19 bp, synthetic construct
  misc_feature 1..19: note = Synthetic Construct
  source 1..19: mol_type = other DNA
gcagccggctccatcagtt

SEQ ID NO: 40689 - DNA, 21 bp, synthetic construct
  misc_feature 1..21: note = Synthetic Construct
  source 1..21: mol_type = other DNA
aggtagatgcctctggctcaa

SEQ ID NO: 40690 - DNA, 23 bp, synthetic construct
  misc_feature 1..23: note = Synthetic Construct
  source 1..23: mol_type = other DNA
cctctgtcgtatcaccgggagaa

SEQ ID NO: 40691 - DNA, 22 bp, synthetic construct
  misc_feature 1..22: note = Synthetic Construct
  source 1..22: mol_type = other DNA
ccgatgctgccttaacctcctt

SEQ ID NO: 40692 - DNA, 22 bp, synthetic construct
  misc_feature 1..22: note = Synthetic Construct
  source 1..22: mol_type = other DNA
ctgctccttccagaagccaaac

SEQ ID NO: 40693 - DNA, 24 bp, synthetic construct
  misc_feature 1..24: note = Synthetic Construct
  source 1..24: mol_type = other DNA
ggacaaacccagagtctcgatgta

SEQ ID NO: 40694 - DNA, 26 bp, synthetic construct
  misc_feature 1..26: note = Synthetic Construct
  source 1..26: mol_type = other DNA
cgaggttttaagaagtgaggctagtt

SEQ ID NO: 40695 - DNA, 23 bp, synthetic construct
  misc_feature 1..23: note = Synthetic Construct
  source 1..23: mol_type = other DNA
acagaagacccgagaaggatgta

SEQ ID NO: 40696 - DNA, 24 bp, synthetic construct
  misc_feature 1..24: note = Synthetic Construct
  source 1..24: mol_type = other DNA
gcaagatgctgttttcttcaccaa

SEQ ID NO: 40697 - DNA, 21 bp, synthetic construct
  misc_feature 1..21: note = Synthetic Construct
  source 1..21: mol_type = other DNA
tgaaccccgtctcagtgactt

SEQ ID NO: 40698 - DNA, 24 bp, synthetic construct
  misc_feature 1..24: note = Synthetic Construct
  source 1..24: mol_type = other DNA
aaagaaaggccctgtaaacagact

SEQ ID NO: 40699 - DNA, 20 bp, synthetic construct
  misc_feature 1..20: note = Synthetic Construct
  source 1..20: mol_type = other DNA
aaccgggacagacggcttca

SEQ ID NO: 40700 - DNA, 30 bp, synthetic construct
  misc_feature 1..30: note = Synthetic Construct
  source 1..30: mol_type = other DNA
gcagaggaggattttgataatcaggtagat

SEQ ID NO: 40701 - DNA, 21 bp, synthetic construct
  misc_feature 1..21: note = Synthetic Construct
  source 1..21: mol_type = other DNA
tgatatcggggcagctctgaa

SEQ ID NO: 40702 - DNA, 23 bp, synthetic construct
  misc_feature 1..23: note = Synthetic Construct
  source 1..23: mol_type = other DNA
ggctgtattgccagagaaacctt

SEQ ID NO: 40703 - DNA, 25 bp, synthetic construct
  misc_feature 1..25: note = Synthetic Construct
  source 1..25: mol_type = other DNA
ccagaaaagcaagcacttgtgtgaa

SEQ ID NO: 40704 - DNA, 26 bp, synthetic construct
  misc_feature 1..26: note = Synthetic Construct
  source 1..26: mol_type = other DNA
agctacccaaacctttattcctgaag

SEQ ID NO: 40705 - DNA, 27 bp, synthetic construct
  misc_feature 1..27: note = Synthetic Construct
  source 1..27: mol_type = other DNA
ggccatgcttgacaggtgtctaaaact

SEQ ID NO: 40706 - DNA, 25 bp, synthetic construct
  misc_feature 1..25: note = Synthetic Construct
  source 1..25: mol_type = other DNA
gggaaaaataggtgctggcccttta

SEQ ID NO: 40707 - DNA, 20 bp, synthetic construct
  misc_feature 1..20: note = Synthetic Construct
  source 1..20: mol_type = other DNA
ctagaagggtggccctcaga

SEQ ID NO: 40708 - DNA, 21 bp, synthetic construct
  misc_feature 1..21: note = Synthetic Construct
  source 1..21: mol_type = other DNA
ggtgggctgcatatgactgaa

SEQ ID NO: 40709 - DNA, 23 bp, synthetic construct
  misc_feature 1..23: note = Synthetic Construct
  source 1..23: mol_type = other DNA
ggcagtgcctttgggtaaagcaa

SEQ ID NO: 40710 - DNA, 25 bp, synthetic construct
  misc_feature 1..25: note = Synthetic Construct
  source 1..25: mol_type = other DNA
acaactttgacttccaaacctcagt

SEQ ID NO: 40711 - DNA, 21 bp, synthetic construct
  misc_feature 1..21: note = Synthetic Construct
  source 1..21: mol_type = other DNA
cctacagagggaagcccaaac

SEQ ID NO: 40712 - DNA, 19 bp, synthetic construct
  misc_feature 1..19: note = Synthetic Construct
  source 1..19: mol_type = other DNA
agcagccgggcaagggaat

SEQ ID NO: 40713 - DNA, 23 bp, synthetic construct
  misc_feature 1..23: note = Synthetic Construct
  source 1..23: mol_type = other DNA
gttcttcacccgttttgaacagt

SEQ ID NO: 40714 - DNA, 27 bp, synthetic construct
  misc_feature 1..27: note = Synthetic Construct
  source 1..27: mol_type = other DNA
gcttatgtctcccaattctctggtgat

SEQ ID NO: 40715 - DNA, 22 bp, synthetic construct
  misc_feature 1..22: note = Synthetic Construct
  source 1..22: mol_type = other DNA
tgttcaggatctgggcagagtt

SEQ ID NO: 40716 - DNA, 19 bp, synthetic construct
  misc_feature 1..19: note = Synthetic Construct
  source 1..19: mol_type = other DNA
acagcccctcagccagttc

SEQ ID NO: 40717 - DNA, 21 bp, synthetic construct
  misc_feature 1..21: note = Synthetic Construct
  source 1..21: mol_type = other DNA
tgggaggaccaggtaccgatt

SEQ ID NO: 40718 - DNA, 24 bp, synthetic construct
  misc_feature 1..24: note = Synthetic Construct
  source 1..24: mol_type = other DNA
ggagccttgcattcagataacctt

SEQ ID NO: 40719 - DNA, 23 bp, synthetic construct
  misc_feature 1..23: note = Synthetic Construct
  source 1..23: mol_type = other DNA
gctggtggtcagagtcaggttag

SEQ ID NO: 40720 - DNA, 22 bp, synthetic construct
  misc_feature 1..22: note = Synthetic Construct
  source 1..22: mol_type = other DNA
agttgagatggggttgggacta

SEQ ID NO: 40721 - DNA, 20 bp, synthetic construct
  misc_feature 1..20: note = Synthetic Construct
  source 1..20: mol_type = other DNA
tgcctgggttgctcttccaa

SEQ ID NO: 40722 - DNA, 20 bp, synthetic construct
  misc_feature 1..20: note = Synthetic Construct
  source 1..20: mol_type = other DNA
aatgaccacctggccctgta

SEQ ID NO: 40723 - DNA, 19 bp, synthetic construct
  misc_feature 1..19: note = Synthetic Construct
  source 1..19: mol_type = other DNA
cgcacaatggctgccaact

SEQ ID NO: 40724 - DNA, 23 bp, synthetic construct
  misc_feature 1..23: note = Synthetic Construct
  source 1..23: mol_type = other DNA
acaggacaaacttgctgtgacaa

SEQ ID NO: 40725 - DNA, 22 bp, synthetic construct
  misc_feature 1..22: note = Synthetic Construct
  source 1..22: mol_type = other DNA
ggcccaatagacaccaccatga

SEQ ID NO: 40726 - DNA, 24 bp, synthetic construct
  misc_feature 1..24: note = Synthetic Construct
  source 1..24: mol_type = other DNA
ccacagccaatcaatcagggaatc

SEQ ID NO: 40727 - DNA, 23 bp, synthetic construct
  misc_feature 1..23: note = Synthetic Construct
  source 1..23: mol_type = other DNA
gcggaagctataggtggactaag

SEQ ID NO: 40728 - DNA, 22 bp, synthetic construct
  misc_feature 1..22: note = Synthetic Construct
  source 1..22: mol_type = other DNA
cagcctcctctgtctctggaaa

SEQ ID NO: 40729 - DNA, 25 bp, synthetic construct
  misc_feature 1..25: note = Synthetic Construct
  source 1..25: mol_type = other DNA
caaggacgacattcctcctaacttg

SEQ ID NO: 40730 - DNA, 25 bp, synthetic construct
  misc_feature 1..25: note = Synthetic Construct
  source 1..25: mol_type = other DNA
gactcgttcatgcaatgaggtgaaa

SEQ ID NO: 40731 - DNA, 23 bp, synthetic construct
  misc_feature 1..23: note = Synthetic Construct
  source 1..23: mol_type = other DNA
gcttggaaatgagcgtgtagctt

SEQ ID NO: 40732 - DNA, 22 bp, synthetic construct
  misc_feature 1..22: note = Synthetic Construct
  source 1..22: mol_type = other DNA
cctctcttccttgctggctgta

SEQ ID NO: 40733 - DNA, 18 bp, synthetic construct
  misc_feature 1..18: note = Synthetic Construct
  source 1..18: mol_type = other DNA
tgccacaatgccgtgagt

SEQ ID NO: 40734 - DNA, 24 bp, synthetic construct
  misc_feature 1..24: note = Synthetic Construct
  source 1..24: mol_type = other DNA
cctccacctgtctgtcaaaagtct

SEQ ID NO: 40735 - DNA, 20 bp, synthetic construct
  misc_feature 1..20: note = Synthetic Construct
  source 1..20: mol_type = other DNA
aaagcacacgccggattttc

SEQ ID NO: 40736 - DNA, 30 bp, synthetic construct
  misc_feature 1..30: note = Synthetic Construct
  source 1..30: mol_type = other DNA
gctttcccatatgttatcccatttgtgctt

SEQ ID NO: 40737 - DNA, 21 bp, synthetic construct
  misc_feature 1..21: note = Synthetic Construct
  source 1..21: mol_type = other DNA
tctctgtggcccagtccctta

SEQ ID NO: 40738 - DNA, 20 bp, synthetic construct
  misc_feature 1..20: note = Synthetic Construct
  source 1..20: mol_type = other DNA
tcccctcagtgggcctgtgt

SEQ ID NO: 40739 - DNA, 21 bp, synthetic construct
  misc_feature 1..21: note = Synthetic Construct
  source 1..21: mol_type = other DNA
agggcgattctgtggctgatg

SEQ ID NO: 40740 - DNA, 21 bp, synthetic construct
  misc_feature 1..21: note = Synthetic Construct
  source 1..21: mol_type = other DNA
aatgggagaggtggccagtca

SEQ ID NO: 40741 - DNA, 24 bp, synthetic construct
  misc_feature 1..24: note = Synthetic Construct
  source 1..24: mol_type = other DNA
aatcttgagaacaaggtggggaaa

SEQ ID NO: 40742 - DNA, 25 bp, synthetic construct
  misc_feature 1..25: note = Synthetic Construct
  source 1..25: mol_type = other DNA
ggagttcaactttccaggagaagaa

SEQ ID NO: 40743 - DNA, 21 bp, synthetic construct
  misc_feature 1..21: note = Synthetic Construct
  source 1..21: mol_type = other DNA
ggaatcagggccatgaacagt

SEQ ID NO: 40744 - DNA, 20 bp, synthetic construct
  misc_feature 1..20: note = Synthetic Construct
  source 1..20: mol_type = other DNA
aatgcccaggccacactgta

SEQ ID NO: 40745 - DNA, 21 bp, synthetic construct
  misc_feature 1..21: note = Synthetic Construct
  source 1..21: mol_type = other DNA
tgatcgtcgttgagcaagtgt

SEQ ID NO: 40746 - DNA, 24 bp, synthetic construct
  misc_feature 1..24: note = Synthetic Construct
  source 1..24: mol_type = other DNA
gatgagaatgaggagggtggaatc

SEQ ID NO: 40747 - DNA, 27 bp, synthetic construct
  misc_feature 1..27: note = Synthetic Construct
  source 1..27: mol_type = other DNA
ggaacaagctttactcacatagagaag

SEQ ID NO: 40748 - DNA, 25 bp, synthetic construct
  misc_feature 1..25: note = Synthetic Construct
  source 1..25: mol_type = other DNA
cttttaaaacgagcgttggctaaac

SEQ ID NO: 40749 - DNA, 24 bp, synthetic construct
  misc_feature 1..24: note = Synthetic Construct
  source 1..24: mol_type = other DNA
ccagccaccttagcttctcctatg

SEQ ID NO: 40750 - DNA, 20 bp, synthetic construct
  misc_feature 1..20: note = Synthetic Construct
  source 1..20: mol_type = other DNA
tggacagccatcctggtgta

SEQ ID NO: 40751 - DNA, 19 bp, synthetic construct
  misc_feature 1..19: note = Synthetic Construct
  source 1..19: mol_type = other DNA
gccgtgcactcatgccatt

SEQ ID NO: 40752 - DNA, 25 bp, synthetic construct
  misc_feature 1..25: note = Synthetic Construct
  source 1..25: mol_type = other DNA
aatcttttctcaggattccgtctgt

SEQ ID NO: 40753 - DNA, 20 bp, synthetic construct
  misc_feature 1..20: note = Synthetic Construct
  source 1..20: mol_type = other DNA
agggaaacactggggcaaac

SEQ ID NO: 40754 - DNA, 24 bp, synthetic construct
  misc_feature 1..24: note = Synthetic Construct
  source 1..24: mol_type = other DNA
ggctgtccatttcaggggatcctt

SEQ ID NO: 40755 - DNA, 21 bp, synthetic construct
  misc_feature 1..21: note = Synthetic Construct
  source 1..21: mol_type = other DNA
gggagcagagagatggagaga

SEQ ID NO: 40756 - DNA, 22 bp, synthetic construct
  misc_feature 1..22: note = Synthetic Construct
  source 1..22: mol_type = other DNA
tggagttaagcaccctccctat

SEQ ID NO: 40757 - DNA, 24 bp, synthetic construct
  misc_feature 1..24: note = Synthetic Construct
  source 1..24: mol_type = other DNA
cagctacattgagggcaatgtctt

SEQ ID NO: 40758 - DNA, 22 bp, synthetic construct
  misc_feature 1..22: note = Synthetic Construct
  source 1..22: mol_type = other DNA
ggggagcatggattctggaaca

SEQ ID NO: 40759 - DNA, 25 bp, synthetic construct
  misc_feature 1..25: note = Synthetic Construct
  source 1..25: mol_type = other DNA
gggcaaaacagacagaaaggtgttg

SEQ ID NO: 40760 - DNA, 26 bp, synthetic construct
  misc_feature 1..26: note = Synthetic Construct
  source 1..26: mol_type = other DNA
ggaagcgatgttaggttaagactaga

SEQ ID NO: 40761 - DNA, 20 bp, synthetic construct
  misc_feature 1..20: note = Synthetic Construct
  source 1..20: mol_type = other DNA
ctgcgtcatccctagcacaa

SEQ ID NO: 40762 - DNA, 22 bp, synthetic construct
  misc_feature 1..22: note = Synthetic Construct
  source 1..22: mol_type = other DNA
ccctggctgtgaggttttagat

SEQ ID NO: 40763 - DNA, 20 bp, synthetic construct
  misc_feature 1..20: note = Synthetic Construct
  source 1..20: mol_type = other DNA
tttgctcggcagccagacat

SEQ ID NO: 40764 - DNA, 22 bp, synthetic construct
  misc_feature 1..22: note = Synthetic Construct
  source 1..22: mol_type = other DNA
cgacagcagagcatcagctaaa

SEQ ID NO: 40765 - DNA, 23 bp, synthetic construct
  misc_feature 1..23: note = Synthetic Construct
  source 1..23: mol_type = other DNA
gccctttcctctgacttaggttt

SEQ ID NO: 40766 - DNA, 20 bp, synthetic construct
  misc_feature 1..20: note = Synthetic Construct
  source 1..20: mol_type = other DNA
gcctcatgcctgcagttcaa

SEQ ID NO: 40767 - DNA, 22 bp, synthetic construct
  misc_feature 1..22: note = Synthetic Construct
  source 1..22: mol_type = other DNA
gccccaatcacaaactgagcat

SEQ ID NO: 40768 - DNA, 24 bp, synthetic construct
  misc_feature 1..24: note = Synthetic Construct
  source 1..24: mol_type = other DNA
tgagggattaacaacggtcaaaca

SEQ ID NO: 40769 - DNA, 24 bp, synthetic construct
  misc_feature 1..24: note = Synthetic Construct
  source 1..24: mol_type = other DNA
gaggtccagtctctttcaccgtat

SEQ ID NO: 40770 - DNA, 21 bp, synthetic construct
  misc_feature 1..21: note = Synthetic Construct
  source 1..21: mol_type = other DNA
gccacctgtttggaggtgagt

SEQ ID NO: 40771 - DNA, 22 bp, synthetic construct
  misc_feature 1..22: note = Synthetic Construct
  source 1..22: mol_type = other DNA
ggtttgcggggaggaaagatga

SEQ ID NO: 40772 - DNA, 22 bp, synthetic construct
  misc_feature 1..22: note = Synthetic Construct
  source 1..22: mol_type = other DNA
gggattgggtggcctagtttga

SEQ ID NO: 40773 - DNA, 21 bp, synthetic construct
  misc_feature 1..21: note = Synthetic Construct
  source 1..21: mol_type = other DNA
gaggaagggaagagcaagcaa

SEQ ID NO: 40774 - DNA, 21 bp, synthetic construct
  misc_feature 1..21: note = Synthetic Construct
  source 1..21: mol_type = other DNA
gcagcacacatcctgtagtga

SEQ ID NO: 40775 - DNA, 23 bp, synthetic construct
  misc_feature 1..23: note = Synthetic Construct
  source 1..23: mol_type = other DNA
gcaagctgaaactctgggcatgt

SEQ ID NO: 40776 - DNA, 23 bp, synthetic construct
  misc_feature 1..23: note = Synthetic Construct
  source 1..23: mol_type = other DNA
catccctggaattagcagtgtct

SEQ ID NO: 40777 - DNA, 23 bp, synthetic construct
  misc_feature 1..23: note = Synthetic Construct
  source 1..23: mol_type = other DNA
gaagagtgagcttcttgcacagt

SEQ ID NO: 40778 - DNA, 21 bp, synthetic construct
  misc_feature 1..21: note = Synthetic Construct
  source 1..21: mol_type = other DNA
gcccaggttccaaccctgatt

SEQ ID NO: 40779 - DNA, 25 bp, synthetic construct
  misc_feature 1..25: note = Synthetic Construct
  source 1..25: mol_type = other DNA
gcttctagtattagcccttcctgtt

SEQ ID NO: 40780 - DNA, 22 bp, synthetic construct
  misc_feature 1..22: note = Synthetic Construct
  source 1..22: mol_type = other DNA
cccctgggcttatgaaccaaac

SEQ ID NO: 40781 - DNA, 20 bp, synthetic construct
  misc_feature 1..20: note = Synthetic Construct
  source 1..20: mol_type = other DNA
ccaccaccacactgttctgt

SEQ ID NO: 40782 - DNA, 23 bp, synthetic construct
  misc_feature 1..23: note = Synthetic Construct
  source 1..23: mol_type = other DNA
gcaaaagtgattggggccagctt

SEQ ID NO: 40783 - DNA, 22 bp, synthetic construct
  misc_feature 1..22: note = Synthetic Construct
  source 1..22: mol_type = other DNA
ggctgggaagctgatgagtcaa

SEQ ID NO: 40784 - DNA, 24 bp, synthetic construct
  misc_feature 1..24: note = Synthetic Construct
  source 1..24: mol_type = other DNA
ggaccagctcaaatgttctcttgt

SEQ ID NO: 40785 - DNA, 25 bp, synthetic construct
  misc_feature 1..25: note = Synthetic Construct
  source 1..25: mol_type = other DNA
ctctggaagatggtggcataaggaa

SEQ ID NO: 40786 - DNA, 22 bp, synthetic construct
  misc_feature 1..22: note = Synthetic Construct
  source 1..22: mol_type = other DNA
agattgccacctggacactttg

SEQ ID NO: 40787 - DNA, 22 bp, synthetic construct
  misc_feature 1..22: note = Synthetic Construct
  source 1..22: mol_type = other DNA
gggatggtgatggggatgacta

SEQ ID NO: 40788 - DNA, 24 bp, synthetic construct
  misc_feature 1..24: note = Synthetic Construct
  source 1..24: mol_type = other DNA
gggagagcaacaagagggaaggat

SEQ ID NO: 40789 - DNA, 25 bp, synthetic construct
  misc_feature 1..25: note = Synthetic Construct
  source 1..25: mol_type = other DNA
gctacacaaactgcatctcttggaa

SEQ ID NO: 40790 - DNA, 24 bp, synthetic construct
  misc_feature 1..24: note = Synthetic Construct
  source 1..24: mol_type = other DNA
ggtgacctagctggggtagtatgt

SEQ ID NO: 40791 - DNA, 22 bp, synthetic construct
  misc_feature 1..22: note = Synthetic Construct
  source 1..22: mol_type = other DNA
ctcctgcaggtggttcaaggta

SEQ ID NO: 40792 - DNA, 20 bp, synthetic construct
  misc_feature 1..20: note = Synthetic Construct
  source 1..20: mol_type = other DNA
ttagaggcaggggcagaaga

SEQ ID NO: 40793 - DNA, 24 bp, synthetic construct
  misc_feature 1..24: note = Synthetic Construct
  source 1..24: mol_type = other DNA
ctctacttccaaggtggtgcctta

SEQ ID NO: 40794 - DNA, 24 bp, synthetic construct
  misc_feature 1..24: note = Synthetic Construct
  source 1..24: mol_type = other DNA
gaaattcagtgggctgagaacctt

SEQ ID NO: 40795 - DNA, 21 bp, synthetic construct
  misc_feature 1..21: note = Synthetic Construct
  source 1..21: mol_type = other DNA
tcagccctctgcatcctgcta

SEQ ID NO: 40796 - DNA, 20 bp, synthetic construct
  misc_feature 1..20: note = Synthetic Construct
  source 1..20: mol_type = other DNA
ttccacagcagggtggtact

SEQ ID NO: 40797 - DNA, 24 bp, synthetic construct
  misc_feature 1..24: note = Synthetic Construct
  source 1..24: mol_type = other DNA
gtgaggcatgcgcagataagattc

SEQ ID NO: 40798 - DNA, 22 bp, synthetic construct
  misc_feature 1..22: note = Synthetic Construct
  source 1..22: mol_type = other DNA
cgtgcctcctgcaagatgaaga

SEQ ID NO: 40799 - DNA, 26 bp, synthetic construct
  misc_feature 1..26: note = Synthetic Construct
  source 1..26: mol_type = other DNA
ggtgaaggactcagtgtccagcatag

SEQ ID NO: 40800 - DNA, 23 bp, synthetic construct
  misc_feature 1..23: note = Synthetic Construct
  source 1..23: mol_type = other DNA
ggtgacactgccagtaacagcaa

SEQ ID NO: 40801 - DNA, 24 bp, synthetic construct
  misc_feature 1..24: note = Synthetic Construct
  source 1..24: mol_type = other DNA
gccctccccttgtattcattccat

SEQ ID NO: 40802 - DNA, 18 bp, synthetic construct
  misc_feature 1..18: note = Synthetic Construct
  source 1..18: mol_type = other DNA
tgagcccagacccacctt

SEQ ID NO: 40803 - DNA, 26 bp, synthetic construct
  misc_feature 1..26: note = Synthetic Construct
  source 1..26: mol_type = other DNA
ctggaactgctggttaatcttgaatc

SEQ ID NO: 40804 - DNA, 22 bp, synthetic construct
  misc_feature 1..22: note = Synthetic Construct
  source 1..22: mol_type = other DNA
tctccagcgtcatggactcaag

SEQ ID NO: 40805 - DNA, 27 bp, synthetic construct
  misc_feature 1..27: note = Synthetic Construct
  source 1..27: mol_type = other DNA
ggtagaaagaaacaattccaggtcaga

SEQ ID NO: 40806 - DNA, 22 bp, synthetic construct
  misc_feature 1..22: note = Synthetic Construct
  source 1..22: mol_type = other DNA
gggttttcaggggtgggtttga

SEQ ID NO: 40807 - DNA, 24 bp, synthetic construct
  misc_feature 1..24: note = Synthetic Construct
  source 1..24: mol_type = other DNA
gcagatggaggttaccaaacttgt

SEQ ID NO: 40808 - DNA, 20 bp, synthetic construct
  misc_feature 1..20: note = Synthetic Construct
  source 1..20: mol_type = other DNA
tgctctgtggggtgccattt

SEQ ID NO: 40809 - DNA, 25 bp, synthetic construct
  misc_feature 1..25: note = Synthetic Construct
  source 1..25: mol_type = other DNA
ccctcttaccccattctcagctctt

SEQ ID NO: 40810 - DNA, 21 bp, synthetic construct
  misc_feature 1..21: note = Synthetic Construct
  source 1..21: mol_type = other DNA
tccccttcctctctgccctta

SEQ ID NO: 40811 - DNA, 21 bp, synthetic construct
  misc_feature 1..21: note = Synthetic Construct
  source 1..21: mol_type = other DNA
aacatctgccgaccgagttag

SEQ ID NO: 40812 - DNA, 25 bp, synthetic construct
  misc_feature 1..25: note = Synthetic Construct
  source 1..25: mol_type = other DNA
cccttaaagtcccaggttaatgagt

SEQ ID NO: 40813 - DNA, 20 bp, synthetic construct
  misc_feature 1..20: note = Synthetic Construct
  source 1..20: mol_type = other DNA
acctggatgcccctgatgat

SEQ ID NO: 40814 - DNA, 24 bp, synthetic construct
  misc_feature 1..24: note = Synthetic Construct
  source 1..24: mol_type = other DNA
gcctttgcattgttttggccattg

SEQ ID NO: 40815 - DNA, 22 bp, synthetic construct
  misc_feature 1..22: note = Synthetic Construct
  source 1..22: mol_type = other DNA
agttttgccagcacttctggat

SEQ ID NO: 40816 - DNA, 24 bp, synthetic construct
  misc_feature 1..24: note = Synthetic Construct
  source 1..24: mol_type = other DNA
ggagtttgagagccaggaggtttc

SEQ ID NO: 40817 - DNA, 22 bp, synthetic construct
  misc_feature 1..22: note = Synthetic Construct
  source 1..22: mol_type = other DNA
ctgatcaaagggcaaggagact

SEQ ID NO: 40818 - DNA, 22 bp, synthetic construct
  misc_feature 1..22: note = Synthetic Construct
  source 1..22: mol_type = other DNA
gctaaggtgggaagggctgttt

SEQ ID NO: 40819 - DNA, 21 bp, synthetic construct
  misc_feature 1..21: note = Synthetic Construct
  source 1..21: mol_type = other DNA
tggggtaaacggtgccataga

SEQ ID NO: 40820 - DNA, 24 bp, synthetic construct
  misc_feature 1..24: note = Synthetic Construct
  source 1..24: mol_type = other DNA
gcctagaattgcaagagtccatga

SEQ ID NO: 40821 - DNA, 22 bp, synthetic construct
  misc_feature 1..22: note = Synthetic Construct
  source 1..22: mol_type = other DNA
gggatggcagcttatgcctaca

SEQ ID NO: 40822 - DNA, 25 bp, synthetic construct
  misc_feature 1..25: note = Synthetic Construct
  source 1..25: mol_type = other DNA
ccctaggagagaagacactttgtga

SEQ ID NO: 40823 - DNA, 25 bp, synthetic construct
  misc_feature 1..25: note = Synthetic Construct
  source 1..25: mol_type = other DNA
ccaccatagacagaaacctgtttga

SEQ ID NO: 40824 - DNA, 20 bp, synthetic construct
  misc_feature 1..20: note = Synthetic Construct
  source 1..20: mol_type = other DNA
ccatgcaacccgaggctcta

SEQ ID NO: 40825 - DNA, 22 bp, synthetic construct
  misc_feature 1..22: note = Synthetic Construct
  source 1..22: mol_type = other DNA
cctaggcacctgagtgctcaaa

SEQ ID NO: 40826 - DNA, 21 bp, synthetic construct
  misc_feature 1..21: note = Synthetic Construct
  source 1..21: mol_type = other DNA
gatttgcctccttggcctgaa

SEQ ID NO: 40827 - DNA, 22 bp, synthetic construct
  misc_feature 1..22: note = Synthetic Construct
  source 1..22: mol_type = other DNA
gctcatggctgattcactcact

SEQ ID NO: 40828 - DNA, 19 bp, synthetic construct
  misc_feature 1..19: note = Synthetic Construct
  source 1..19: mol_type = other DNA
cccgtcccaggtgtcatgt

SEQ ID NO: 40829 - DNA, 20 bp, synthetic construct
  misc_feature 1..20: note = Synthetic Construct
  source 1..20: mol_type = other DNA
ggctgaaaaggtgcctgctt

SEQ ID NO: 40830 - DNA, 25 bp, synthetic construct
  misc_feature 1..25: note = Synthetic Construct
  source 1..25: mol_type = other DNA
ttggtaagaagaaggtgcaaaggta

SEQ ID NO: 40831 - DNA, 22 bp, synthetic construct
  misc_feature 1..22: note = Synthetic Construct
  source 1..22: mol_type = other DNA
ggactgtaagccaggactctct

SEQ ID NO: 40832 - DNA, 24 bp, synthetic construct
  misc_feature 1..24: note = Synthetic Construct
  source 1..24: mol_type = other DNA
cccctgcccctaaaacttgtcttc

SEQ ID NO: 40833 - DNA, 23 bp, synthetic construct
  misc_feature 1..23: note = Synthetic Construct
  source 1..23: mol_type = other DNA
gctgccaacatctgtgactgtag

SEQ ID NO: 40834 - DNA, 25 bp, synthetic construct
  misc_feature 1..25: note = Synthetic Construct
  source 1..25: mol_type = other DNA
ggagagagaaccctgatcaaatcat

SEQ ID NO: 40835 - DNA, 20 bp, synthetic construct
  misc_feature 1..20: note = Synthetic Construct
  source 1..20: mol_type = other DNA
acgaacgcacacgggacttt

SEQ ID NO: 40836 - DNA, 25 bp, synthetic construct
  misc_feature 1..25: note = Synthetic Construct
  source 1..25: mol_type = other DNA
ctggtgcttccaacactaaaagcaa

SEQ ID NO: 40837 - DNA, 25 bp, synthetic construct
  misc_feature 1..25: note = Synthetic Construct
  source 1..25: mol_type = other DNA
agaataaaatctgcaaggggctgta

SEQ ID NO: 40838 - DNA, 25 bp, synthetic construct
  misc_feature 1..25: note = Synthetic Construct
  source 1..25: mol_type = other DNA
cgaaacacacaaggatgggaaagaa

SEQ ID NO: 40839 - DNA, 23 bp, synthetic construct
  misc_feature 1..23: note = Synthetic Construct
  source 1..23: mol_type = other DNA
gtggagctcatctctctccaaag

SEQ ID NO: 40840 - DNA, 23 bp, synthetic construct
  misc_feature 1..23: note = Synthetic Construct
  source 1..23: mol_type = other DNA
gtctttaccaccttcagccttgt

SEQ ID NO: 40841 - DNA, 21 bp, synthetic construct
  misc_feature 1..21: note = Synthetic Construct
  source 1..21: mol_type = other DNA
gggcccagacactatgtgctt

SEQ ID NO: 40842 - DNA, 20 bp, synthetic construct
  misc_feature 1..20: note = Synthetic Construct
  source 1..20: mol_type = other DNA
ggatcaggctgctggactgt

SEQ ID NO: 40843 - DNA, 24 bp, synthetic construct
  misc_feature 1..24: note = Synthetic Construct
  source 1..24: mol_type = other DNA
ggttgtagaactacagtccccatt

SEQ ID NO: 40844 - DNA, 24 bp, synthetic construct
  misc_feature 1..24: note = Synthetic Construct
  source 1..24: mol_type = other DNA
gggttaattcagggtctccactct

SEQ ID NO: 40845 - DNA, 23 bp, synthetic construct
  misc_feature 1..23: note = Synthetic Construct
  source 1..23: mol_type = other DNA
ggggtcaacaaatgtgggctaga

SEQ ID NO: 40846 - DNA, 30 bp, synthetic construct
  misc_feature 1..30: note = Synthetic Construct
  source 1..30: mol_type = other DNA
cgagaaacggatcattaaacagtagtgtga

SEQ ID NO: 40847 - DNA, 26 bp, synthetic construct
  misc_feature 1..26: note = Synthetic Construct
  source 1..26: mol_type = other DNA
cctaaaataccttcctccgattgctt

SEQ ID NO: 40848 - DNA, 23 bp, synthetic construct
  misc_feature 1..23: note = Synthetic Construct
  source 1..23: mol_type = other DNA
cgctggtttctggcttcagaact

SEQ ID NO: 40849 - DNA, 21 bp, synthetic construct
  misc_feature 1..21: note = Synthetic Construct
  source 1..21: mol_type = other DNA
agacttcaggcagggagctta

SEQ ID NO: 40850 - DNA, 20 bp, synthetic construct
  misc_feature 1..20: note = Synthetic Construct
  source 1..20: mol_type = other DNA
tgcacacacagcccctcaat

SEQ ID NO: 40851 - DNA, 19 bp, synthetic construct
  misc_feature 1..19: note = Synthetic Construct
  source 1..19: mol_type = other DNA
agggtcctccaccctctga

SEQ ID NO: 40852 - DNA, 23 bp, synthetic construct
  misc_feature 1..23: note = Synthetic Construct
  source 1..23: mol_type = other DNA
ggcagagagtgaaagggaagtag

SEQ ID NO: 40853 - DNA, 24 bp, synthetic construct
  misc_feature 1..24: note = Synthetic Construct
  source 1..24: mol_type = other DNA
caacttcaccaggggtttatcact

SEQ ID NO: 40854 - DNA, 20 bp, synthetic construct
  misc_feature 1..20: note = Synthetic Construct
  source 1..20: mol_type = other DNA
agtccaagcctgggtccaaa

SEQ ID NO: 40855 - DNA, 26 bp, synthetic construct
  misc_feature 1..26: note = Synthetic Construct
  source 1..26: mol_type = other DNA
cagaccttcatgctgaggtgaatttg

SEQ ID NO: 40856 - DNA, 25 bp, synthetic construct
  misc_feature 1..25: note = Synthetic Construct
  source 1..25: mol_type = other DNA
cccatccaaggggctataaaagtga

SEQ ID NO: 40857 - DNA, 22 bp, synthetic construct
  misc_feature 1..22: note = Synthetic Construct
  source 1..22: mol_type = other DNA
agtagggtggttcccagcagat

SEQ ID NO: 40858 - DNA, 22 bp, synthetic construct
  misc_feature 1..22: note = Synthetic Construct
  source 1..22: mol_type = other DNA
gtgctcatgccagcagcaatag

SEQ ID NO: 40859 - DNA, 23 bp, synthetic construct
  misc_feature 1..23: note = Synthetic Construct
  source 1..23: mol_type = other DNA
agaggaacagagcagttttgcat

SEQ ID NO: 40860 - DNA, 20 bp, synthetic construct
  misc_feature 1..20: note = Synthetic Construct
  source 1..20: mol_type = other DNA
gcccatgccaacaaggtgaa

SEQ ID NO: 40861 - DNA, 24 bp, synthetic construct
  misc_feature 1..24: note = Synthetic Construct
  source 1..24: mol_type = other DNA
ggggatgagcagaagggagagttt

SEQ ID NO: 40862 - DNA, 24 bp, synthetic construct
  misc_feature 1..24: note = Synthetic Construct
  source 1..24: mol_type = other DNA
tttctttcagtggctaagctgttg

SEQ ID NO: 40863 - DNA, 22 bp, synthetic construct
  misc_feature 1..22: note = Synthetic Construct
  source 1..22: mol_type = other DNA
ggttgtggctgtaacctgcatt

SEQ ID NO: 40864 - DNA, 25 bp, synthetic construct
  misc_feature 1..25: note = Synthetic Construct
  source 1..25: mol_type = other DNA
cctggatatcgagcaacaagaaaga

SEQ ID NO: 40865 - DNA, 23 bp, synthetic construct
  misc_feature 1..23: note = Synthetic Construct
  source 1..23: mol_type = other DNA
gaagatggcagcatggaatctca

SEQ ID NO: 40866 - DNA, 20 bp, synthetic construct
  misc_feature 1..20: note = Synthetic Construct
  source 1..20: mol_type = other DNA
acaagtatggcggggctgta

SEQ ID NO: 40867 - DNA, 21 bp, synthetic construct
  misc_feature 1..21: note = Synthetic Construct
  source 1..21: mol_type = other DNA
tccgccaatggtgagagaaag

SEQ ID NO: 40868 - DNA, 25 bp, synthetic construct
  misc_feature 1..25: note = Synthetic Construct
  source 1..25: mol_type = other DNA
ccaaatcctgggatcctgtgaggta

SEQ ID NO: 40869 - DNA, 19 bp, synthetic construct
  misc_feature 1..19: note = Synthetic Construct
  source 1..19: mol_type = other DNA
tcacgggcaggccagagta

SEQ ID NO: 40870 - DNA, 19 bp, synthetic construct
  misc_feature 1..19: note = Synthetic Construct
  source 1..19: mol_type = other DNA
agcagcaccctctgtggaa

SEQ ID NO: 40871 - DNA, 23 bp, synthetic construct
  misc_feature 1..23: note = Synthetic Construct
  source 1..23: mol_type = other DNA
actaagacagtgacctgctccat

SEQ ID NO: 40872 - DNA, 25 bp, synthetic construct
  misc_feature 1..25: note = Synthetic Construct
  source 1..25: mol_type = other DNA
ccaaaccatatcaatgacccaccaa

SEQ ID NO: 40873 - DNA, 22 bp, synthetic construct
  misc_feature 1..22: note = Synthetic Construct
  source 1..22: mol_type = other DNA
agcttccctaacatgccagttt

SEQ ID NO: 40874 - DNA, 27 bp, synthetic construct
  misc_feature 1..27: note = Synthetic Construct
  source 1..27: mol_type = other DNA
tgatgtcaagtaactacccagatgttc

SEQ ID NO: 40875 - DNA, 20 bp, synthetic construct
  misc_feature 1..20: note = Synthetic Construct
  source 1..20: mol_type = other DNA
cctgagcctgcccaggtttt

SEQ ID NO: 40876 - DNA, 22 bp, synthetic construct
  misc_feature 1..22: note = Synthetic Construct
  source 1..22: mol_type = other DNA
ggaggaaggtggctggattttg

SEQ ID NO: 40877 - DNA, 18 bp, synthetic construct
  misc_feature 1..18: note = Synthetic Construct
  source 1..18: mol_type = other DNA
ttgccccaggtgctctgt

SEQ ID NO: 40878 - DNA, 22 bp, synthetic construct
  misc_feature 1..22: note = Synthetic Construct
  source 1..22: mol_type = other DNA
tgtcccagctccatccctttct

SEQ ID NO: 40879 - DNA, 21 bp, synthetic construct
  misc_feature 1..21: note = Synthetic Construct
  source 1..21: mol_type = other DNA
aagctgctgggactggacaca

SEQ ID NO: 40880 - DNA, 20 bp, synthetic construct
  misc_feature 1..20: note = Synthetic Construct
  source 1..20: mol_type = other DNA
cctgccccaggggttctttc

SEQ ID NO: 40881 - DNA, 27 bp, synthetic construct
  misc_feature 1..27: note = Synthetic Construct
  source 1..27: mol_type = other DNA
gccataaatgggtcctctgaggcaata

SEQ ID NO: 40882 - DNA, 23 bp, synthetic construct
  misc_feature 1..23: note = Synthetic Construct
  source 1..23: mol_type = other DNA
gtatggctagctgctacatgtct

SEQ ID NO: 40883 - DNA, 21 bp, synthetic construct
  misc_feature 1..21: note = Synthetic Construct
  source 1..21: mol_type = other DNA
ttgcttggggcaggaggacta

SEQ ID NO: 40884 - DNA, 20 bp, synthetic construct
  misc_feature 1..20: note = Synthetic Construct
  source 1..20: mol_type = other DNA
tgggtgggcacaggctggta

SEQ ID NO: 40885 - DNA, 24 bp, synthetic construct
  misc_feature 1..24: note = Synthetic Construct
  source 1..24: mol_type = other DNA
ggctgacatagggcactgtcttac

SEQ ID NO: 40886 - DNA, 21 bp, synthetic construct
  misc_feature 1..21: note = Synthetic Construct
  source 1..21: mol_type = other DNA
actgtgtgtgcttcagctgtt

SEQ ID NO: 40887 - DNA, 26 bp, synthetic construct
  misc_feature 1..26: note = Synthetic Construct
  source 1..26: mol_type = other DNA
cgcaaatcagttaatgggtacggtaa

SEQ ID NO: 40888 - DNA, 20 bp, synthetic construct
  misc_feature 1..20: note = Synthetic Construct
  source 1..20: mol_type = other DNA
tgctggcagagcatccctaa

SEQ ID NO: 40889 - DNA, 20 bp, synthetic construct
  misc_feature 1..20: note = Synthetic Construct
  source 1..20: mol_type = other DNA
cctcagtgcaagccagacat

SEQ ID NO: 40890 - DNA, 19 bp, synthetic construct
  misc_feature 1..19: note = Synthetic Construct
  source 1..19: mol_type = other DNA
tctgggcgaccgtccacat

SEQ ID NO: 40891 - DNA, 25 bp, synthetic construct
  misc_feature 1..25: note = Synthetic Construct
  source 1..25: mol_type = other DNA
ctgctttctcatacctccagccttt

SEQ ID NO: 40892 - DNA, 23 bp, synthetic construct
  misc_feature 1..23: note = Synthetic Construct
  source 1..23: mol_type = other DNA
gggattgacaggtggaaacttca

SEQ ID NO: 40893 - DNA, 20 bp, synthetic construct
  misc_feature 1..20: note = Synthetic Construct
  source 1..20: mol_type = other DNA
ctgcaagaagggctgtggaa

SEQ ID NO: 40894 - DNA, 21 bp, synthetic construct
  misc_feature 1..21: note = Synthetic Construct
  source 1..21: mol_type = other DNA
aagacccaggctgctggaaga

SEQ ID NO: 40895 - DNA, 24 bp, synthetic construct
  misc_feature 1..24: note = Synthetic Construct
  source 1..24: mol_type = other DNA
gctgtgggaaatagtcccatcaca

SEQ ID NO: 40896 - DNA, 24 bp, synthetic construct
  misc_feature 1..24: note = Synthetic Construct
  source 1..24: mol_type = other DNA
ggctaaagttgaaggggcatcatc

SEQ ID NO: 40897 - DNA, 26 bp, synthetic construct
  misc_feature 1..26: note = Synthetic Construct
  source 1..26: mol_type = other DNA
ggaccagtcctttttgtttggactgt

SEQ ID NO: 40898 - DNA, 21 bp, synthetic construct
  misc_feature 1..21: note = Synthetic Construct
  source 1..21: mol_type = other DNA
gctgtggttgaggaagcacta

SEQ ID NO: 40899 - DNA, 22 bp, synthetic construct
  misc_feature 1..22: note = Synthetic Construct
  source 1..22: mol_type = other DNA
tgccattgaattgacccaccaa

SEQ ID NO: 40900 - DNA, 20 bp, synthetic construct
  misc_feature 1..20: note = Synthetic Construct
  source 1..20: mol_type = other DNA
accccgccttatgctgagat

SEQ ID NO: 40901 - DNA, 24 bp, synthetic construct
  misc_feature 1..24: note = Synthetic Construct
  source 1..24: mol_type = other DNA
ccctgtacttacctgtgacacttc

SEQ ID NO: 40902 - DNA, 24 bp, synthetic construct
  misc_feature 1..24: note = Synthetic Construct
  source 1..24: mol_type = other DNA
catctcccctagtcattgctgaga

SEQ ID NO: 40903 - DNA, 20 bp, synthetic construct
  misc_feature 1..20: note = Synthetic Construct
  source 1..20: mol_type = other DNA
tggggcagcaatgtctggaa

SEQ ID NO: 40904 - DNA, 21 bp, synthetic construct
  misc_feature 1..21: note = Synthetic Construct
  source 1..21: mol_type = other DNA
acctgggaggtcctcacttca

SEQ ID NO: 40905 - DNA, 19 bp, synthetic construct
  misc_feature 1..19: note = Synthetic Construct
  source 1..19: mol_type = other DNA
tggctgtgggatggtgagt

SEQ ID NO: 40906 - DNA, 20 bp, synthetic construct
  misc_feature 1..20: note = Synthetic Construct
  source 1..20: mol_type = other DNA
aatcccaccatcgcccagaa

SEQ ID NO: 40907 - DNA, 23 bp, synthetic construct
  misc_feature 1..23: note = Synthetic Construct
  source 1..23: mol_type = other DNA
agcaggtaaccttggaaaacact

SEQ ID NO: 40908 - DNA, 24 bp, synthetic construct
  misc_feature 1..24: note = Synthetic Construct
  source 1..24: mol_type = other DNA
gggacctagacaagtgctgtcctt

SEQ ID NO: 40909 - DNA, 20 bp, synthetic construct
  misc_feature 1..20: note = Synthetic Construct
  source 1..20: mol_type = other DNA
gcgtttcccacttgcctgtt

SEQ ID NO: 40910 - DNA, 21 bp, synthetic construct
  misc_feature 1..21: note = Synthetic Construct
  source 1..21: mol_type = other DNA
ggatagacgctccgcagtgat

SEQ ID NO: 40911 - DNA, 29 bp, synthetic construct
  misc_feature 1..29: note = Synthetic Construct
  source 1..29: mol_type = other DNA
gtcatatacctttataccagaccctgttg

SEQ ID NO: 40912 - DNA, 24 bp, synthetic construct
  misc_feature 1..24: note = Synthetic Construct
  source 1..24: mol_type = other DNA
aaagatttgcttgcctggaagaag

SEQ ID NO: 40913 - DNA, 23 bp, synthetic construct
  misc_feature 1..23: note = Synthetic Construct
  source 1..23: mol_type = other DNA
ccagggaatctgtgggcagaatg

SEQ ID NO: 40914 - DNA, 20 bp, synthetic construct
  misc_feature 1..20: note = Synthetic Construct
  source 1..20: mol_type = other DNA
actgcgggcagatacacaca

SEQ ID NO: 40915 - DNA, 21 bp, synthetic construct
  misc_feature 1..21: note = Synthetic Construct
  source 1..21: mol_type = other DNA
aggtcacaggtgcaaaccatt

SEQ ID NO: 40916 - DNA, 26 bp, synthetic construct
  misc_feature 1..26: note = Synthetic Construct
  source 1..26: mol_type = other DNA
cctgagctgtttctgaactcctcaca

SEQ ID NO: 40917 - DNA, 23 bp, synthetic construct
  misc_feature 1..23: note = Synthetic Construct
  source 1..23: mol_type = other DNA
gttcaggggtttctaccttgcat

SEQ ID NO: 40918 - DNA, 22 bp, synthetic construct
  misc_feature 1..22: note = Synthetic Construct
  source 1..22: mol_type = other DNA
ggctcaagtgatcctcccaagt

SEQ ID NO: 40919 - DNA, 20 bp, synthetic construct
  misc_feature 1..20: note = Synthetic Construct
  source 1..20: mol_type = other DNA
tcacatgccacctcctctga

SEQ ID NO: 40920 - DNA, 24 bp, synthetic construct
  misc_feature 1..24: note = Synthetic Construct
  source 1..24: mol_type = other DNA
cctcgctatatcagggagtagctt

SEQ ID NO: 40921 - DNA, 20 bp, synthetic construct
  misc_feature 1..20: note = Synthetic Construct
  source 1..20: mol_type = other DNA
tgtgaccaccagggttccat

SEQ ID NO: 40922 - DNA, 22 bp, synthetic construct
  misc_feature 1..22: note = Synthetic Construct
  source 1..22: mol_type = other DNA
ggttgactgccacctgaggaat

SEQ ID NO: 40923 - DNA, 22 bp, synthetic construct
  misc_feature 1..22: note = Synthetic Construct
  source 1..22: mol_type = other DNA
tccatctctgggctctgctatc

SEQ ID NO: 40924 - DNA, 23 bp, synthetic construct
  misc_feature 1..23: note = Synthetic Construct
  source 1..23: mol_type = other DNA
tgtggaatgtgagtttcctgtga

SEQ ID NO: 40925 - DNA, 20 bp, synthetic construct
  misc_feature 1..20: note = Synthetic Construct
  source 1..20: mol_type = other DNA
cctcctgccacatgcacact

SEQ ID NO: 40926 - DNA, 22 bp, synthetic construct
  misc_feature 1..22: note = Synthetic Construct
  source 1..22: mol_type = other DNA
gctgtgtttccttgccttggtt

SEQ ID NO: 40927 - DNA, 25 bp, synthetic construct
  misc_feature 1..25: note = Synthetic Construct
  source 1..25: mol_type = other DNA
gggaggaattttccctgtcccaaga

SEQ ID NO: 40928 - DNA, 20 bp, synthetic construct
  misc_feature 1..20: note = Synthetic Construct
  source 1..20: mol_type = other DNA
agagcccatatcccggtctt

SEQ ID NO: 40929 - DNA, 25 bp, synthetic construct
  misc_feature 1..25: note = Synthetic Construct
  source 1..25: mol_type = other DNA
cagagccaaactgtatcaacctagt

SEQ ID NO: 40930 - DNA, 20 bp, synthetic construct
  misc_feature 1..20: note = Synthetic Construct
  source 1..20: mol_type = other DNA
tgtagccagggtggtctctt

SEQ ID NO: 40931 - DNA, 20 bp, synthetic construct
  misc_feature 1..20: note = Synthetic Construct
  source 1..20: mol_type = other DNA
ccaaaatgccgagggccaaa

SEQ ID NO: 40932 - DNA, 22 bp, synthetic construct
  misc_feature 1..22: note = Synthetic Construct
  source 1..22: mol_type = other DNA
ggaaggtcaatgttgcctcaga

SEQ ID NO: 40933 - DNA, 22 bp, synthetic construct
  misc_feature 1..22: note = Synthetic Construct
  source 1..22: mol_type = other DNA
gggttacccttgctccatccaa

SEQ ID NO: 40934 - DNA, 20 bp, synthetic construct
  misc_feature 1..20: note = Synthetic Construct
  source 1..20: mol_type = other DNA
catggctgagctgctgcata

SEQ ID NO: 40935 - DNA, 19 bp, synthetic construct
  misc_feature 1..19: note = Synthetic Construct
  source 1..19: mol_type = other DNA
ggctctcagcctcccttca

SEQ ID NO: 40936 - DNA, 24 bp, synthetic construct
  misc_feature 1..24: note = Synthetic Construct
  source 1..24: mol_type = other DNA
cactggatgatagccacaccatct

SEQ ID NO: 40937 - DNA, 22 bp, synthetic construct
  misc_feature 1..22: note = Synthetic Construct
  source 1..22: mol_type = other DNA
cccaagctacagggctcaaaga

SEQ ID NO: 40938 - DNA, 20 bp, synthetic construct
  misc_feature 1..20: note = Synthetic Construct
  source 1..20: mol_type = other DNA
gtcctgcggtccacaaaatg

SEQ ID NO: 40939 - DNA, 20 bp, synthetic construct
  misc_feature 1..20: note = Synthetic Construct
  source 1..20: mol_type = other DNA
ttctcacctcccaccacaga

SEQ ID NO: 40940 - DNA, 26 bp, synthetic construct
  misc_feature 1..26: note = Synthetic Construct
  source 1..26: mol_type = other DNA
gcagtgagtagagcaaggtaggaact

SEQ ID NO: 40941 - DNA, 22 bp, synthetic construct
  misc_feature 1..22: note = Synthetic Construct
  source 1..22: mol_type = other DNA
gcaagtgtgaacaagtgtggaa

SEQ ID NO: 40942 - DNA, 21 bp, synthetic construct
  misc_feature 1..21: note = Synthetic Construct
  source 1..21: mol_type = other DNA
gcaaggtgaggacaacacagt

SEQ ID NO: 40943 - DNA, 25 bp, synthetic construct
  misc_feature 1..25: note = Synthetic Construct
  source 1..25: mol_type = other DNA
gaaaggtgtctctttacctctgagt

SEQ ID NO: 40944 - DNA, 23 bp, synthetic construct
  misc_feature 1..23: note = Synthetic Construct
  source 1..23: mol_type = other DNA
gtggcattccagaccttgtggta

SEQ ID NO: 40945 - DNA, 21 bp, synthetic construct
  misc_feature 1..21: note = Synthetic Construct
  source 1..21: mol_type = other DNA
ggtgtgcacttgtcggctatg

SEQ ID NO: 40946 - DNA, 26 bp, synthetic construct
  misc_feature 1..26: note = Synthetic Construct
  source 1..26: mol_type = other DNA
ctgtgaatgtgatgctaaggttgttc

SEQ ID NO: 40947 - DNA, 22 bp, synthetic construct
  misc_feature 1..22: note = Synthetic Construct
  source 1..22: mol_type = other DNA
caggccttctggattccgtcta

SEQ ID NO: 40948 - DNA, 20 bp, synthetic construct
  misc_feature 1..20: note = Synthetic Construct
  source 1..20: mol_type = other DNA
tgcacgtaggctggggtaac

SEQ ID NO: 40949 - DNA, 24 bp, synthetic construct
  misc_feature 1..24: note = Synthetic Construct
  source 1..24: mol_type = other DNA
cccgagccttagaaagaccccata

SEQ ID NO: 40950 - DNA, 23 bp, synthetic construct
  misc_feature 1..23: note = Synthetic Construct
  source 1..23: mol_type = other DNA
acagagcttaaggtcaggaccaa

SEQ ID NO: 40951 - DNA, 30 bp, synthetic construct
  misc_feature 1..30: note = Synthetic Construct
  source 1..30: mol_type = other DNA
ccttagtacttaagatgcaagtgtccatac

SEQ ID NO: 40952 - DNA, 23 bp, synthetic construct
  misc_feature 1..23: note = Synthetic Construct
  source 1..23: mol_type = other DNA
ttcctgccagtgttaactcacaa

SEQ ID NO: 40953 - DNA, 23 bp, synthetic construct
  misc_feature 1..23: note = Synthetic Construct
  source 1..23: mol_type = other DNA
ctctgtcaggactccagtctcat

SEQ ID NO: 40954 - DNA, 18 bp, synthetic construct
  misc_feature 1..18: note = Synthetic Construct
  source 1..18: mol_type = other DNA
tgggaggggcaagtggaa

SEQ ID NO: 40955 - DNA, 25 bp, synthetic construct
  misc_feature 1..25: note = Synthetic Construct
  source 1..25: mol_type = other DNA
ccgcttgaggaaaggtgcagattag

SEQ ID NO: 40956 - DNA, 22 bp, synthetic construct
  misc_feature 1..22: note = Synthetic Construct
  source 1..22: mol_type = other DNA
ccatgggttggcaggaaactga

SEQ ID NO: 40957 - DNA, 24 bp, synthetic construct
  misc_feature 1..24: note = Synthetic Construct
  source 1..24: mol_type = other DNA
gaagggtagagcctcatgtctttg

SEQ ID NO: 40958 - DNA, 25 bp, synthetic construct
  misc_feature 1..25: note = Synthetic Construct
  source 1..25: mol_type = other DNA
gagaacaggttgatgacaggttttg

SEQ ID NO: 40959 - DNA, 20 bp, synthetic construct
  misc_feature 1..20: note = Synthetic Construct
  source 1..20: mol_type = other DNA
tgccccactcccaacacact

SEQ ID NO: 40960 - DNA, 23 bp, synthetic construct
  misc_feature 1..23: note = Synthetic Construct
  source 1..23: mol_type = other DNA
cgccagtcagacctaagctcttc

SEQ ID NO: 40961 - DNA, 21 bp, synthetic construct
  misc_feature 1..21: note = Synthetic Construct
  source 1..21: mol_type = other DNA
ggctccccgcatccataaaga

SEQ ID NO: 40962 - DNA, 28 bp, synthetic construct
  misc_feature 1..28: note = Synthetic Construct
  source 1..28: mol_type = other DNA
ccctggaaacatagattgttggttggta

SEQ ID NO: 40963 - DNA, 23 bp, synthetic construct
  misc_feature 1..23: note = Synthetic Construct
  source 1..23: mol_type = other DNA
gtccaggattcagggcctcaaaa

SEQ ID NO: 40964 - DNA, 21 bp, synthetic construct
  misc_feature 1..21: note = Synthetic Construct
  source 1..21: mol_type = other DNA
ccaggttgccacacattctct

SEQ ID NO: 40965 - DNA, 22 bp, synthetic construct
  misc_feature 1..22: note = Synthetic Construct
  source 1..22: mol_type = other DNA
gggctttccctcagacagacaa

SEQ ID NO: 40966 - DNA, 22 bp, synthetic construct
  misc_feature 1..22: note = Synthetic Construct
  source 1..22: mol_type = other DNA
ggaaagtcagcacaggggaaga

SEQ ID NO: 40967 - DNA, 24 bp, synthetic construct
  misc_feature 1..24: note = Synthetic Construct
  source 1..24: mol_type = other DNA
gcacatgttgcaataagccaggta

SEQ ID NO: 40968 - DNA, 23 bp, synthetic construct
  misc_feature 1..23: note = Synthetic Construct
  source 1..23: mol_type = other DNA
gcaccctgtcttttctcaccatt

SEQ ID NO: 40969 - DNA, 20 bp, synthetic construct
  misc_feature 1..20: note = Synthetic Construct
  source 1..20: mol_type = other DNA
gggatgggcagcaacttaca

SEQ ID NO: 40970 - DNA, 22 bp, synthetic construct
  misc_feature 1..22: note = Synthetic Construct
  source 1..22: mol_type = other DNA
cctgcagaactggtgtgacaag

SEQ ID NO: 40971 - DNA, 24 bp, synthetic construct
  misc_feature 1..24: note = Synthetic Construct
  source 1..24: mol_type = other DNA
gaaaagtccaggaggaaacctttg

SEQ ID NO: 40972 - DNA, 22 bp, synthetic construct
  misc_feature 1..22: note = Synthetic Construct
  source 1..22: mol_type = other DNA
gctggtgaaggacgtcaccttt

SEQ ID NO: 40973 - DNA, 25 bp, synthetic construct
  misc_feature 1..25: note = Synthetic Construct
  source 1..25: mol_type = other DNA
gtaaaatcctgccacctctgtaaac

SEQ ID NO: 40974 - DNA, 25 bp, synthetic construct
  misc_feature 1..25: note = Synthetic Construct
  source 1..25: mol_type = other DNA
ggtgtagagtaggtgctcagtcaca

SEQ ID NO: 40975 - DNA, 22 bp, synthetic construct
  misc_feature 1..22: note = Synthetic Construct
  source 1..22: mol_type = other DNA
tggcctcagagctcttgtctct

SEQ ID NO: 40976 - DNA, 20 bp, synthetic construct
  misc_feature 1..20: note = Synthetic Construct
  source 1..20: mol_type = other DNA
tcctcccttttgggcacttg

SEQ ID NO: 40977 - DNA, 25 bp, synthetic construct
  misc_feature 1..25: note = Synthetic Construct
  source 1..25: mol_type = other DNA
gggctcacctaacctggtatcaaga

SEQ ID NO: 40978 - DNA, 22 bp, synthetic construct
  misc_feature 1..22: note = Synthetic Construct
  source 1..22: mol_type = other DNA
ccacttggtgcagtgaggaaga

SEQ ID NO: 40979 - DNA, 21 bp, synthetic construct
  misc_feature 1..21: note = Synthetic Construct
  source 1..21: mol_type = other DNA
ttcgcagggtctgggagtctt

SEQ ID NO: 40980 - DNA, 25 bp, synthetic construct
  misc_feature 1..25: note = Synthetic Construct
  source 1..25: mol_type = other DNA
ccgagtccaactacactgtgccttt

SEQ ID NO: 40981 - DNA, 27 bp, synthetic construct
  misc_feature 1..27: note = Synthetic Construct
  source 1..27: mol_type = other DNA
ggttgtgaatcagaaggctagtaggtt

SEQ ID NO: 40982 - DNA, 21 bp, synthetic construct
  misc_feature 1..21: note = Synthetic Construct
  source 1..21: mol_type = other DNA
ccaggcaagtgggaggagtag

SEQ ID NO: 40983 - DNA, 25 bp, synthetic construct
  misc_feature 1..25: note = Synthetic Construct
  source 1..25: mol_type = other DNA
gtgttagaactcagtggaggctaaa

SEQ ID NO: 40984 - DNA, 20 bp, synthetic construct
  misc_feature 1..20: note = Synthetic Construct
  source 1..20: mol_type = other DNA
accccttgctgtcagtgaac

SEQ ID NO: 40985 - DNA, 22 bp, synthetic construct
  misc_feature 1..22: note = Synthetic Construct
  source 1..22: mol_type = other DNA
ggatgagcttggatgcggttct

SEQ ID NO: 40986 - DNA, 24 bp, synthetic construct
  misc_feature 1..24: note = Synthetic Construct
  source 1..24: mol_type = other DNA
cagtggttagattgtctcgcttct

SEQ ID NO: 40987 - DNA, 25 bp, synthetic construct
  misc_feature 1..25: note = Synthetic Construct
  source 1..25: mol_type = other DNA
tgaggaaagtgagaacaggtgtcta

SEQ ID NO: 40988 - DNA, 26 bp, synthetic construct
  misc_feature 1..26: note = Synthetic Construct
  source 1..26: mol_type = other DNA
cgcgagacagatctatgctcactttg

SEQ ID NO: 40989 - DNA, 22 bp, synthetic construct
  misc_feature 1..22: note = Synthetic Construct
  source 1..22: mol_type = other DNA
aggaataatggggctgggattg

SEQ ID NO: 40990 - DNA, 21 bp, synthetic construct
  misc_feature 1..21: note = Synthetic Construct
  source 1..21: mol_type = other DNA
ccatctggcagcctttcttct

SEQ ID NO: 40991 - DNA, 23 bp, synthetic construct
  misc_feature 1..23: note = Synthetic Construct
  source 1..23: mol_type = other DNA
gtttctccagccttcacttccaa

SEQ ID NO: 40992 - DNA, 20 bp, synthetic construct
  misc_feature 1..20: note = Synthetic Construct
  source 1..20: mol_type = other DNA
ctggccaggatggggttttt

SEQ ID NO: 40993 - DNA, 21 bp, synthetic construct
  misc_feature 1..21: note = Synthetic Construct
  source 1..21: mol_type = other DNA
gggcggccagagaaaacatac

SEQ ID NO: 40994 - DNA, 25 bp, synthetic construct
  misc_feature 1..25: note = Synthetic Construct
  source 1..25: mol_type = other DNA
gagaagaaggaatgaggggagaaca

SEQ ID NO: 40995 - DNA, 21 bp, synthetic construct
  misc_feature 1..21: note = Synthetic Construct
  source 1..21: mol_type = other DNA
ttcacccctggtcaaggatct

SEQ ID NO: 40996 - DNA, 20 bp, synthetic construct
  misc_feature 1..20: note = Synthetic Construct
  source 1..20: mol_type = other DNA
tgccaaagagggcctgaaga

SEQ ID NO: 40997 - DNA, 23 bp, synthetic construct
  misc_feature 1..23: note = Synthetic Construct
  source 1..23: mol_type = other DNA
gcctagacgagctgatctgagta

SEQ ID NO: 40998 - DNA, 20 bp, synthetic construct
  misc_feature 1..20: note = Synthetic Construct
  source 1..20: mol_type = other DNA
ttccagcatgggccagattg

SEQ ID NO: 40999 - DNA, 23 bp, synthetic construct
  misc_feature 1..23: note = Synthetic Construct
  source 1..23: mol_type = other DNA
ccctgtcacagcttgcctctatc

SEQ ID NO: 41000 - DNA, 25 bp, synthetic construct
  misc_feature 1..25: note = Synthetic Construct
  source 1..25: mol_type = other DNA
accaggatttgaagatatgccatga

SEQ ID NO: 41001 - DNA, 23 bp, synthetic construct
  misc_feature 1..23: note = Synthetic Construct
  source 1..23: mol_type = other DNA
gccagaatcctggtagtgtgctt

SEQ ID NO: 41002 - DNA, 25 bp, synthetic construct
  misc_feature 1..25: note = Synthetic Construct
  source 1..25: mol_type = other DNA
aggtattttgggacagacactgatt

SEQ ID NO: 41003 - DNA, 22 bp, synthetic construct
  misc_feature 1..22: note = Synthetic Construct
  source 1..22: mol_type = other DNA
gagggtcaccagaatcgcaaac

SEQ ID NO: 41004 - DNA, 27 bp, synthetic construct
  misc_feature 1..27: note = Synthetic Construct
  source 1..27: mol_type = other DNA
gaaccacttcaggtatcactagattgt

SEQ ID NO: 41005 - DNA, 23 bp, synthetic construct
  misc_feature 1..23: note = Synthetic Construct
  source 1..23: mol_type = other DNA
tttccctggagcatatccacttg

SEQ ID NO: 41006 - DNA, 25 bp, synthetic construct
  misc_feature 1..25: note = Synthetic Construct
  source 1..25: mol_type = other DNA
ggcaaaacatatgctgtcccaaatg

SEQ ID NO: 41007 - DNA, 24 bp, synthetic construct
  misc_feature 1..24: note = Synthetic Construct
  source 1..24: mol_type = other DNA
gcaggtggaggagtactaggatca

SEQ ID NO: 41008 - DNA, 24 bp, synthetic construct
  misc_feature 1..24: note = Synthetic Construct
  source 1..24: mol_type = other DNA
gcctgctgctaaggtttcttggtt

SEQ ID NO: 41009 - DNA, 21 bp, synthetic construct
  misc_feature 1..21: note = Synthetic Construct
  source 1..21: mol_type = other DNA
gatgctgtctacggcttgtga

SEQ ID NO: 41010 - DNA, 20 bp, synthetic construct
  misc_feature 1..20: note = Synthetic Construct
  source 1..20: mol_type = other DNA
agggagcaggccatggatgt

SEQ ID NO: 41011 - DNA, 21 bp, synthetic construct
  misc_feature 1..21: note = Synthetic Construct
  source 1..21: mol_type = other DNA
aggctggacaaggggcatgta

SEQ ID NO: 41012 - DNA, 23 bp, synthetic construct
  misc_feature 1..23: note = Synthetic Construct
  source 1..23: mol_type = other DNA
ggcagtatcagaaacccaagagt

SEQ ID NO: 41013 - DNA, 25 bp, synthetic construct
  misc_feature 1..25: note = Synthetic Construct
  source 1..25: mol_type = other DNA
gggaagtttttcaaaaggccagttc

SEQ ID NO: 41014 - DNA, 20 bp, synthetic construct
  misc_feature 1..20: note = Synthetic Construct
  source 1..20: mol_type = other DNA
tgccaagggcgtggtaagta

SEQ ID NO: 41015 - DNA, 22 bp, synthetic construct
  misc_feature 1..22: note = Synthetic Construct
  source 1..22: mol_type = other DNA
gcccatgacagcttcattcagt

SEQ ID NO: 41016 - DNA, 22 bp, synthetic construct
  misc_feature 1..22: note = Synthetic Construct
  source 1..22: mol_type = other DNA
gtagctcaaactgcaggggaaa

SEQ ID NO: 41017 - DNA, 19 bp, synthetic construct
  misc_feature 1..19: note = Synthetic Construct
  source 1..19: mol_type = other DNA
aaccaagccccgcctgact

SEQ ID NO: 41018 - DNA, 23 bp, synthetic construct
  misc_feature 1..23: note = Synthetic Construct
  source 1..23: mol_type = other DNA
gcccagcaaaggttgataacagt

SEQ ID NO: 41019 - DNA, 22 bp, synthetic construct
  misc_feature 1..22: note = Synthetic Construct
  source 1..22: mol_type = other DNA
aggctacatgctccctggagtt

SEQ ID NO: 41020 - DNA, 20 bp, synthetic construct
  misc_feature 1..20: note = Synthetic Construct
  source 1..20: mol_type = other DNA
cccggactcagccagacttg

SEQ ID NO: 41021 - DNA, 19 bp, synthetic construct
  misc_feature 1..19: note = Synthetic Construct
  source 1..19: mol_type = other DNA
gggtgggcggaatcagcat

SEQ ID NO: 41022 - DNA, 24 bp, synthetic construct
  misc_feature 1..24: note = Synthetic Construct
  source 1..24: mol_type = other DNA
ctgtcaatgtctacagcaggaagt

SEQ ID NO: 41023 - DNA, 21 bp, synthetic construct
  misc_feature 1..21: note = Synthetic Construct
  source 1..21: mol_type = other DNA
accccagccatcacacccaaa

SEQ ID NO: 41024 - DNA, 23 bp, synthetic construct
  misc_feature 1..23: note = Synthetic Construct
  source 1..23: mol_type = other DNA
gtctgtcctcacacctactgttc

SEQ ID NO: 41025 - DNA, 24 bp, synthetic construct
  misc_feature 1..24: note = Synthetic Construct
  source 1..24: mol_type = other DNA
cagtctgctggcttcaagatgttt

SEQ ID NO: 41026 - DNA, 25 bp, synthetic construct
  misc_feature 1..25: note = Synthetic Construct
  source 1..25: mol_type = other DNA
gctgggtggtaaagagaggttcctt

SEQ ID NO: 41027 - DNA, 25 bp, synthetic construct
  misc_feature 1..25: note = Synthetic Construct
  source 1..25: mol_type = other DNA
caccgagttgaaaagcaatggaatc

SEQ ID NO: 41028 - DNA, 23 bp, synthetic construct
  misc_feature 1..23: note = Synthetic Construct
  source 1..23: mol_type = other DNA
caaccacgtaagtgatcgtggaa

SEQ ID NO: 41029 - DNA, 24 bp, synthetic construct
  misc_feature 1..24: note = Synthetic Construct
  source 1..24: mol_type = other DNA
caaaggactgaccacctagagtca

SEQ ID NO: 41030 - DNA, 23 bp, synthetic construct
  misc_feature 1..23: note = Synthetic Construct
  source 1..23: mol_type = other DNA
ggagttctacagccacgttcttc

SEQ ID NO: 41031 - DNA, 25 bp, synthetic construct
  misc_feature 1..25: note = Synthetic Construct
  source 1..25: mol_type = other DNA
tctgaatagtaaacgttgccaccta

SEQ ID NO: 41032 - DNA, 22 bp, synthetic construct
  misc_feature 1..22: note = Synthetic Construct
  source 1..22: mol_type = other DNA
ggctggcttctcatcacccttt

SEQ ID NO: 41033 - DNA, 20 bp, synthetic construct
  misc_feature 1..20: note = Synthetic Construct
  source 1..20: mol_type = other DNA
tggaggctgtcccagtatgt

SEQ ID NO: 41034 - DNA, 25 bp, synthetic construct
  misc_feature 1..25: note = Synthetic Construct
  source 1..25: mol_type = other DNA
gaaaaaggcaaaagtccttgctcat

SEQ ID NO: 41035 - DNA, 25 bp, synthetic construct
  misc_feature 1..25: note = Synthetic Construct
  source 1..25: mol_type = other DNA
cctgtaattccatttgctggtgact

SEQ ID NO: 41036 - DNA, 25 bp, synthetic construct
  misc_feature 1..25: note = Synthetic Construct
  source 1..25: mol_type = other DNA
gtggtgtctcctgaagctgagtatc

SEQ ID NO: 41037 - DNA, 25 bp, synthetic construct
  misc_feature 1..25: note = Synthetic Construct
  source 1..25: mol_type = other DNA
cctctcacaacttgcttggccttac

SEQ ID NO: 41038 - DNA, 19 bp, synthetic construct
  misc_feature 1..19: note = Synthetic Construct
  source 1..19: mol_type = other DNA
ggcctctgagggagcaagt

SEQ ID NO: 41039 - DNA, 25 bp, synthetic construct
  misc_feature 1..25: note = Synthetic Construct
  source 1..25: mol_type = other DNA
ctgtgtttttggaggaccggtttac

SEQ ID NO: 41040 - DNA, 20 bp, synthetic construct
  misc_feature 1..20: note = Synthetic Construct
  source 1..20: mol_type = other DNA
ggccgagtctgtcattgcat

SEQ ID NO: 41041 - DNA, 22 bp, synthetic construct
  misc_feature 1..22: note = Synthetic Construct
  source 1..22: mol_type = other DNA
aagcccctaccaaacaacactt

SEQ ID NO: 41042 - DNA, 20 bp, synthetic construct
  misc_feature 1..20: note = Synthetic Construct
  source 1..20: mol_type = other DNA
acaggtgtgagccactgtga

SEQ ID NO: 41043 - DNA, 20 bp, synthetic construct
  misc_feature 1..20: note = Synthetic Construct
  source 1..20: mol_type = other DNA
aggagggaccagagccgttt

SEQ ID NO: 41044 - DNA, 24 bp, synthetic construct
  misc_feature 1..24: note = Synthetic Construct
  source 1..24: mol_type = other DNA
gccagtgtttgtccctaaggtaag

SEQ ID NO: 41045 - DNA, 21 bp, synthetic construct
  misc_feature 1..21: note = Synthetic Construct
  source 1..21: mol_type = other DNA
gcctggcctttgcttttgctt

SEQ ID NO: 41046 - DNA, 21 bp, synthetic construct
  misc_feature 1..21: note = Synthetic Construct
  source 1..21: mol_type = other DNA
ccagccctttcatcagcttgt

SEQ ID NO: 41047 - DNA, 24 bp, synthetic construct
  misc_feature 1..24: note = Synthetic Construct
  source 1..24: mol_type = other DNA
gctcgaggctgtacagatgtttct

SEQ ID NO: 41048 - DNA, 21 bp, synthetic construct
  misc_feature 1..21: note = Synthetic Construct
  source 1..21: mol_type = other DNA
agcctgtggagtgcctctgtt

SEQ ID NO: 41049 - DNA, 22 bp, synthetic construct
  misc_feature 1..22: note = Synthetic Construct
  source 1..22: mol_type = other DNA
ggtggaagccagattgggcaaa

SEQ ID NO: 41050 - DNA, 19 bp, synthetic construct
  misc_feature 1..19: note = Synthetic Construct
  source 1..19: mol_type = other DNA
gccagagctgcagcagaga

SEQ ID NO: 41051 - DNA, 27 bp, synthetic construct
  misc_feature 1..27: note = Synthetic Construct
  source 1..27: mol_type = other DNA
ggcttatacttaaggcatctggacatc

SEQ ID NO: 41052 - DNA, 25 bp, synthetic construct
  misc_feature 1..25: note = Synthetic Construct
  source 1..25: mol_type = other DNA
agttctacctgaagccaatgctatc

SEQ ID NO: 41053 - DNA, 22 bp, synthetic construct
  misc_feature 1..22: note = Synthetic Construct
  source 1..22: mol_type = other DNA
aggcccttggcagccttaattc

SEQ ID NO: 41054 - DNA, 25 bp, synthetic construct
  misc_feature 1..25: note = Synthetic Construct
  source 1..25: mol_type = other DNA
aggttaaaacaccgtaagaggttga

SEQ ID NO: 41055 - DNA, 23 bp, synthetic construct
  misc_feature 1..23: note = Synthetic Construct
  source 1..23: mol_type = other DNA
cctgagtctcactctggctccta

SEQ ID NO: 41056 - DNA, 22 bp, synthetic construct
  misc_feature 1..22: note = Synthetic Construct
  source 1..22: mol_type = other DNA
gccggggaaatctttcttcaca

SEQ ID NO: 41057 - DNA, 22 bp, synthetic construct
  misc_feature 1..22: note = Synthetic Construct
  source 1..22: mol_type = other DNA
gcctatctctcaggtcggtctt

SEQ ID NO: 41058 - DNA, 21 bp, synthetic construct
  misc_feature 1..21: note = Synthetic Construct
  source 1..21: mol_type = other DNA
aaggccatgggcgggagagtt

SEQ ID NO: 41059 - DNA, 23 bp, synthetic construct
  misc_feature 1..23: note = Synthetic Construct
  source 1..23: mol_type = other DNA
cctcagaagggagggaacaccat

SEQ ID NO: 41060 - DNA, 22 bp, synthetic construct
  misc_feature 1..22: note = Synthetic Construct
  source 1..22: mol_type = other DNA
aaactggcctaaaccacagtga

SEQ ID NO: 41061 - DNA, 23 bp, synthetic construct
  misc_feature 1..23: note = Synthetic Construct
  source 1..23: mol_type = other DNA
ggcaccatgacatgaacgagact

SEQ ID NO: 41062 - DNA, 26 bp, synthetic construct
  misc_feature 1..26: note = Synthetic Construct
  source 1..26: mol_type = other DNA
gtgacttcctgcagttaccaatctgt

SEQ ID NO: 41063 - DNA, 25 bp, synthetic construct
  misc_feature 1..25: note = Synthetic Construct
  source 1..25: mol_type = other DNA
cccacaccttttctggaaagataga

SEQ ID NO: 41064 - DNA, 26 bp, synthetic construct
  misc_feature 1..26: note = Synthetic Construct
  source 1..26: mol_type = other DNA
ccaaagacctcaccatagtggtttac

SEQ ID NO: 41065 - DNA, 21 bp, synthetic construct
  misc_feature 1..21: note = Synthetic Construct
  source 1..21: mol_type = other DNA
ccccactaaacctcccagtga

SEQ ID NO: 41066 - DNA, 20 bp, synthetic construct
  misc_feature 1..20: note = Synthetic Construct
  source 1..20: mol_type = other DNA
gccatcacagcttcctggtt

SEQ ID NO: 41067 - DNA, 20 bp, synthetic construct
  misc_feature 1..20: note = Synthetic Construct
  source 1..20: mol_type = other DNA
ggctgctgtgtccagtgtgt

SEQ ID NO: 41068 - DNA, 22 bp, synthetic construct
  misc_feature 1..22: note = Synthetic Construct
  source 1..22: mol_type = other DNA
ctgctcataaaccaggcagcat

SEQ ID NO: 41069 - DNA, 26 bp, synthetic construct
  misc_feature 1..26: note = Synthetic Construct
  source 1..26: mol_type = other DNA
gactttctccccaaatggtagtgaac

SEQ ID NO: 41070 - DNA, 19 bp, synthetic construct
  misc_feature 1..19: note = Synthetic Construct
  source 1..19: mol_type = other DNA
tcccctggctcttcccttt

SEQ ID NO: 41071 - DNA, 25 bp, synthetic construct
  misc_feature 1..25: note = Synthetic Construct
  source 1..25: mol_type = other DNA
gcggaaggtactgtacagcatcaca

SEQ ID NO: 41072 - DNA, 25 bp, synthetic construct
  misc_feature 1..25: note = Synthetic Construct
  source 1..25: mol_type = other DNA
cgaaccaaagatgtgtctccagtat

SEQ ID NO: 41073 - DNA, 20 bp, synthetic construct
  misc_feature 1..20: note = Synthetic Construct
  source 1..20: mol_type = other DNA
ccgggagctaggaggagaga

SEQ ID NO: 41074 - DNA, 20 bp, synthetic construct
  misc_feature 1..20: note = Synthetic Construct
  source 1..20: mol_type = other DNA
atgggaccagttgcggttag

SEQ ID NO: 41075 - DNA, 20 bp, synthetic construct
  misc_feature 1..20: note = Synthetic Construct
  source 1..20: mol_type = other DNA
tcgcggagcccagaggttct

SEQ ID NO: 41076 - DNA, 23 bp, synthetic construct
  misc_feature 1..23: note = Synthetic Construct
  source 1..23: mol_type = other DNA
ccctttgaccccagacaggtagt

SEQ ID NO: 41077 - DNA, 24 bp, synthetic construct
  misc_feature 1..24: note = Synthetic Construct
  source 1..24: mol_type = other DNA
gcccaatttggctggaaagataat

SEQ ID NO: 41078 - DNA, 20 bp, synthetic construct
  misc_feature 1..20: note = Synthetic Construct
  source 1..20: mol_type = other DNA
tgacagtggcggttgagaga

SEQ ID NO: 41079 - DNA, 20 bp, synthetic construct
  misc_feature 1..20: note = Synthetic Construct
  source 1..20: mol_type = other DNA
gcaactgagggtgtggaagt

SEQ ID NO: 41080 - DNA, 23 bp, synthetic construct
  misc_feature 1..23: note = Synthetic Construct
  source 1..23: mol_type = other DNA
catggaggtacactgccgtaaag

SEQ ID NO: 41081 - DNA, 21 bp, synthetic construct
  misc_feature 1..21: note = Synthetic Construct
  source 1..21: mol_type = other DNA
ttccaggaaggccggggtttt

SEQ ID NO: 41082 - DNA, 24 bp, synthetic construct
  misc_feature 1..24: note = Synthetic Construct
  source 1..24: mol_type = other DNA
gccatctcagggtcagtgactatc

SEQ ID NO: 41083 - DNA, 25 bp, synthetic construct
  misc_feature 1..25: note = Synthetic Construct
  source 1..25: mol_type = other DNA
ccatctcctatgtccttggttgagt

SEQ ID NO: 41084 - DNA, 25 bp, synthetic construct
  misc_feature 1..25: note = Synthetic Construct
  source 1..25: mol_type = other DNA
tctggtacccttcagtaatggatca

SEQ ID NO: 41085 - DNA, 22 bp, synthetic construct
  misc_feature 1..22: note = Synthetic Construct
  source 1..22: mol_type = other DNA
gggaactggatttcaggacaca

SEQ ID NO: 41086 - DNA, 24 bp, synthetic construct
  misc_feature 1..24: note = Synthetic Construct
  source 1..24: mol_type = other DNA
cactccacctccagtctcttgttc

SEQ ID NO: 41087 - DNA, 23 bp, synthetic construct
  misc_feature 1..23: note = Synthetic Construct
  source 1..23: mol_type = other DNA
cagccgaacaaggatgaggatct

SEQ ID NO: 41088 - DNA, 22 bp, synthetic construct
  misc_feature 1..22: note = Synthetic Construct
  source 1..22: mol_type = other DNA
gcggctctaacacttccagcaa

SEQ ID NO: 41089 - DNA, 22 bp, synthetic construct
  misc_feature 1..22: note = Synthetic Construct
  source 1..22: mol_type = other DNA
gtgtcggttctctccagcgtta

SEQ ID NO: 41090 - DNA, 28 bp, synthetic construct
  misc_feature 1..28: note = Synthetic Construct
  source 1..28: mol_type = other DNA
cctgtttgagtctaatcgttccctctct

SEQ ID NO: 41091 - DNA, 27 bp, synthetic construct
  misc_feature 1..27: note = Synthetic Construct
  source 1..27: mol_type = other DNA
ggggagagaaaatgggaaagcaagtag

SEQ ID NO: 41092 - DNA, 24 bp, synthetic construct
  misc_feature 1..24: note = Synthetic Construct
  source 1..24: mol_type = other DNA
ccttcaacaggatagcaccgtttc

SEQ ID NO: 41093 - DNA, 24 bp, synthetic construct
  misc_feature 1..24: note = Synthetic Construct
  source 1..24: mol_type = other DNA
gcagatctttcactggaggagaca

SEQ ID NO: 41094 - DNA, 20 bp, synthetic construct
  misc_feature 1..20: note = Synthetic Construct
  source 1..20: mol_type = other DNA
ttgcctccaggtgggactgt

SEQ ID NO: 41095 - DNA, 20 bp, synthetic construct
  misc_feature 1..20: note = Synthetic Construct
  source 1..20: mol_type = other DNA
agcaccatccatcggtcaca

SEQ ID NO: 41096 - DNA, 21 bp, synthetic construct
  misc_feature 1..21: note = Synthetic Construct
  source 1..21: mol_type = other DNA
tccctggggagaccctactca

SEQ ID NO: 41097 - DNA, 19 bp, synthetic construct
  misc_feature 1..19: note = Synthetic Construct
  source 1..19: mol_type = other DNA
tctcacccgcaaggtggaa

SEQ ID NO: 41098 - DNA, 22 bp, synthetic construct
  misc_feature 1..22: note = Synthetic Construct
  source 1..22: mol_type = other DNA
cataagcacccaagtgctgcta

SEQ ID NO: 41099 - DNA, 20 bp, synthetic construct
  misc_feature 1..20: note = Synthetic Construct
  source 1..20: mol_type = other DNA
agctgggatgtggctgtttg

SEQ ID NO: 41100 - DNA, 25 bp, synthetic construct
  misc_feature 1..25: note = Synthetic Construct
  source 1..25: mol_type = other DNA
gagacaaatgtaacagggtggtttg

SEQ ID NO: 41101 - DNA, 20 bp, synthetic construct
  misc_feature 1..20: note = Synthetic Construct
  source 1..20: mol_type = other DNA
aaccatgccagcctgctcta

SEQ ID NO: 41102 - DNA, 23 bp, synthetic construct
  misc_feature 1..23: note = Synthetic Construct
  source 1..23: mol_type = other DNA
ggggattgttgaaggtggtgtga

SEQ ID NO: 41103 - DNA, 20 bp, synthetic construct
  misc_feature 1..20: note = Synthetic Construct
  source 1..20: mol_type = other DNA
agaaagggctggttggcatt

SEQ ID NO: 41104 - DNA, 20 bp, synthetic construct
  misc_feature 1..20: note = Synthetic Construct
  source 1..20: mol_type = other DNA
gggacctcccctgtgtctgt

SEQ ID NO: 41105 - DNA, 20 bp, synthetic construct
  misc_feature 1..20: note = Synthetic Construct
  source 1..20: mol_type = other DNA
ggtccagcacaccctgaagt

SEQ ID NO: 41106 - DNA, 21 bp, synthetic construct
  misc_feature 1..21: note = Synthetic Construct
  source 1..21: mol_type = other DNA
ctggcatcgctcgaattcact

SEQ ID NO: 41107 - DNA, 19 bp, synthetic construct
  misc_feature 1..19: note = Synthetic Construct
  source 1..19: mol_type = other DNA
tcgctggcccttcatccat

SEQ ID NO: 41108 - DNA, 24 bp, synthetic construct
  misc_feature 1..24: note = Synthetic Construct
  source 1..24: mol_type = other DNA
cgaggaagacctgactcagaaatc

SEQ ID NO: 41109 - DNA, 19 bp, synthetic construct
  misc_feature 1..19: note = Synthetic Construct
  source 1..19: mol_type = other DNA
acgcagacctggctgttca

SEQ ID NO: 41110 - DNA, 26 bp, synthetic construct
  misc_feature 1..26: note = Synthetic Construct
  source 1..26: mol_type = other DNA
cagtttcttgtatctggcttctctgt

SEQ ID NO: 41111 - DNA, 20 bp, synthetic construct
  misc_feature 1..20: note = Synthetic Construct
  source 1..20: mol_type = other DNA
agggtttggcttggctcttg

SEQ ID NO: 41112 - DNA, 25 bp, synthetic construct
  misc_feature 1..25: note = Synthetic Construct
  source 1..25: mol_type = other DNA
cccagttacactcttgaccccatgt

SEQ ID NO: 41113 - DNA, 23 bp, synthetic construct
  misc_feature 1..23: note = Synthetic Construct
  source 1..23: mol_type = other DNA
gcagagtgcatctgtgagacaac

SEQ ID NO: 41114 - DNA, 22 bp, synthetic construct
  misc_feature 1..22: note = Synthetic Construct
  source 1..22: mol_type = other DNA
gcaggatttgcctgtgcagtga

SEQ ID NO: 41115 - DNA, 24 bp, synthetic construct
  misc_feature 1..24: note = Synthetic Construct
  source 1..24: mol_type = other DNA
aggtgcttcgacagaagtacatag

SEQ ID NO: 41116 - DNA, 19 bp, synthetic construct
  misc_feature 1..19: note = Synthetic Construct
  source 1..19: mol_type = other DNA
acagcgtggcatgctttct

SEQ ID NO: 41117 - DNA, 22 bp, synthetic construct
  misc_feature 1..22: note = Synthetic Construct
  source 1..22: mol_type = other DNA
tctagaagcctccctcctcaca

SEQ ID NO: 41118 - DNA, 24 bp, synthetic construct
  misc_feature 1..24: note = Synthetic Construct
  source 1..24: mol_type = other DNA
tctctgaaaaggaggcaaggaaac

SEQ ID NO: 41119 - DNA, 26 bp, synthetic construct
  misc_feature 1..26: note = Synthetic Construct
  source 1..26: mol_type = other DNA
ctcattatcagttttcaggccacgtt

SEQ ID NO: 41120 - DNA, 29 bp, synthetic construct
  misc_feature 1..29: note = Synthetic Construct
  source 1..29: mol_type = other DNA
gggtgaatgttgcaggcatggtataaaac

SEQ ID NO: 41121 - DNA, 22 bp, synthetic construct
  misc_feature 1..22: note = Synthetic Construct
  source 1..22: mol_type = other DNA
tggaaacctccttaccctctgt

SEQ ID NO: 41122 - DNA, 25 bp, synthetic construct
  misc_feature 1..25: note = Synthetic Construct
  source 1..25: mol_type = other DNA
ctggaaagaggtgagaaatgctgtt

SEQ ID NO: 41123 - DNA, 20 bp, synthetic construct
  misc_feature 1..20: note = Synthetic Construct
  source 1..20: mol_type = other DNA
accagggcgcagatcacctt

SEQ ID NO: 41124 - DNA, 20 bp, synthetic construct
  misc_feature 1..20: note = Synthetic Construct
  source 1..20: mol_type = other DNA
tcaggcggttgaaggaggaa

SEQ ID NO: 41125 - DNA, 19 bp, synthetic construct
  misc_feature 1..19: note = Synthetic Construct
  source 1..19: mol_type = other DNA
ggcaaccaccacaccaaac

SEQ ID NO: 41126 - DNA, 26 bp, synthetic construct
  misc_feature 1..26: note = Synthetic Construct
  source 1..26: mol_type = other DNA
gcagttggcttgattggatcgtgata

SEQ ID NO: 41127 - DNA, 22 bp, synthetic construct
  misc_feature 1..22: note = Synthetic Construct
  source 1..22: mol_type = other DNA
gtagcccttgggttttggctta

SEQ ID NO: 41128 - DNA, 23 bp, synthetic construct
  misc_feature 1..23: note = Synthetic Construct
  source 1..23: mol_type = other DNA
acaagtttggtgacaagggaaga

SEQ ID NO: 41129 - DNA, 20 bp, synthetic construct
  misc_feature 1..20: note = Synthetic Construct
  source 1..20: mol_type = other DNA
tctgtgcctgtcctcccaat

SEQ ID NO: 41130 - DNA, 20 bp, synthetic construct
  misc_feature 1..20: note = Synthetic Construct
  source 1..20: mol_type = other DNA
tggctcccacacctccatct

SEQ ID NO: 41131 - DNA, 23 bp, synthetic construct
  misc_feature 1..23: note = Synthetic Construct
  source 1..23: mol_type = other DNA
ggctctgtgaataccaggagttt

SEQ ID NO: 41132 - DNA, 20 bp, synthetic construct
  misc_feature 1..20: note = Synthetic Construct
  source 1..20: mol_type = other DNA
gggaaaggcagcatgtgtgt

SEQ ID NO: 41133 - DNA, 20 bp, synthetic construct
  misc_feature 1..20: note = Synthetic Construct
  source 1..20: mol_type = other DNA
cagacgcctgaatgccaact

SEQ ID NO: 41134 - DNA, 25 bp, synthetic construct
  misc_feature 1..25: note = Synthetic Construct
  source 1..25: mol_type = other DNA
agggtgtattgctttctccatttct

SEQ ID NO: 41135 - DNA, 19 bp, synthetic construct
  misc_feature 1..19: note = Synthetic Construct
  source 1..19: mol_type = other DNA
aggtcccaggacccagaca

SEQ ID NO: 41136 - DNA, 20 bp, synthetic construct
  misc_feature 1..20: note = Synthetic Construct
  source 1..20: mol_type = other DNA
atgctgggctcagacacact

SEQ ID NO: 41137 - DNA, 25 bp, synthetic construct
  misc_feature 1..25: note = Synthetic Construct
  source 1..25: mol_type = other DNA
ggtgagtgctcagtttcacctctga

SEQ ID NO: 41138 - DNA, 25 bp, synthetic construct
  misc_feature 1..25: note = Synthetic Construct
  source 1..25: mol_type = other DNA
cacatggtttctacagttgcctgtt

SEQ ID NO: 41139 - DNA, 20 bp, synthetic construct
  misc_feature 1..20: note = Synthetic Construct
  source 1..20: mol_type = other DNA
gggctgtgtgagaaggacaa

SEQ ID NO: 41140 - DNA, 23 bp, synthetic construct
  misc_feature 1..23: note = Synthetic Construct
  source 1..23: mol_type = other DNA
ggctgttagtgagaggccacttt

SEQ ID NO: 41141 - DNA, 22 bp, synthetic construct
  misc_feature 1..22: note = Synthetic Construct
  source 1..22: mol_type = other DNA
ccaagcaggtagctgggagaaa

SEQ ID NO: 41142 - DNA, 24 bp, synthetic construct
  misc_feature 1..24: note = Synthetic Construct
  source 1..24: mol_type = other DNA
tggaacaatgggatgaagatcgaa

SEQ ID NO: 41143 - DNA, 23 bp, synthetic construct
  misc_feature 1..23: note = Synthetic Construct
  source 1..23: mol_type = other DNA
cctcaatgtatgccaacgggaaa

SEQ ID NO: 41144 - DNA, 22 bp, synthetic construct
  misc_feature 1..22: note = Synthetic Construct
  source 1..22: mol_type = other DNA
ctgggagtgacttcctcacact

SEQ ID NO: 41145 - DNA, 26 bp, synthetic construct
  misc_feature 1..26: note = Synthetic Construct
  source 1..26: mol_type = other DNA
cacactgtacaatagtggagccaaac

SEQ ID NO: 41146 - DNA, 21 bp, synthetic construct
  misc_feature 1..21: note = Synthetic Construct
  source 1..21: mol_type = other DNA
agacagcagcaggctcagttg

SEQ ID NO: 41147 - DNA, 22 bp, synthetic construct
  misc_feature 1..22: note = Synthetic Construct
  source 1..22: mol_type = other DNA
gaagacatgggcagagaagcaa

SEQ ID NO: 41148 - DNA, 25 bp, synthetic construct
  misc_feature 1..25: note = Synthetic Construct
  source 1..25: mol_type = other DNA
acttccaaatgtgtttccagtctct

SEQ ID NO: 41149 - DNA, 20 bp, synthetic construct
  misc_feature 1..20: note = Synthetic Construct
  source 1..20: mol_type = other DNA
acccacacagatgggctctt

SEQ ID NO: 41150 - DNA, 24 bp, synthetic construct
  misc_feature 1..24: note = Synthetic Construct
  source 1..24: mol_type = other DNA
ctgtccagccttgattctttggaa

SEQ ID NO: 41151 - DNA, 23 bp, synthetic construct
  misc_feature 1..23: note = Synthetic Construct
  source 1..23: mol_type = other DNA
tgtcgtgtttctccatgttccat

SEQ ID NO: 41152 - DNA, 25 bp, synthetic construct
  misc_feature 1..25: note = Synthetic Construct
  source 1..25: mol_type = other DNA
gagtatctgtgtgccagtgtacttc

SEQ ID NO: 41153 - DNA, 21 bp, synthetic construct
  misc_feature 1..21: note = Synthetic Construct
  source 1..21: mol_type = other DNA
gccttgagaccttgcgagtga

SEQ ID NO: 41154 - DNA, 22 bp, synthetic construct
  misc_feature 1..22: note = Synthetic Construct
  source 1..22: mol_type = other DNA
ccaagatgaccacgtcctggaa

SEQ ID NO: 41155 - DNA, 23 bp, synthetic construct
  misc_feature 1..23: note = Synthetic Construct
  source 1..23: mol_type = other DNA
gcagaactgtctgaccacccaaa

SEQ ID NO: 41156 - DNA, 23 bp, synthetic construct
  misc_feature 1..23: note = Synthetic Construct
  source 1..23: mol_type = other DNA
tctgggaaccaaaacaagcacta

SEQ ID NO: 41157 - DNA, 24 bp, synthetic construct
  misc_feature 1..24: note = Synthetic Construct
  source 1..24: mol_type = other DNA
ggtcccatacagaaggggatcttg

SEQ ID NO: 41158 - DNA, 25 bp, synthetic construct
  misc_feature 1..25: note = Synthetic Construct
  source 1..25: mol_type = other DNA
gctgaaaccaagtcctgtagcatca

SEQ ID NO: 41159 - DNA, 22 bp, synthetic construct
  misc_feature 1..22: note = Synthetic Construct
  source 1..22: mol_type = other DNA
gctgttgacacagtccctgcat

SEQ ID NO: 41160 - DNA, 24 bp, synthetic construct
  misc_feature 1..24: note = Synthetic Construct
  source 1..24: mol_type = other DNA
agtttcagtctcacccagttcaag

SEQ ID NO: 41161 - DNA, 22 bp, synthetic construct
  misc_feature 1..22: note = Synthetic Construct
  source 1..22: mol_type = other DNA
acgctatgtgctgtgactccta

SEQ ID NO: 41162 - DNA, 23 bp, synthetic construct
  misc_feature 1..23: note = Synthetic Construct
  source 1..23: mol_type = other DNA
cggtttagagcatgtgggctttg

SEQ ID NO: 41163 - DNA, 24 bp, synthetic construct
  misc_feature 1..24: note = Synthetic Construct
  source 1..24: mol_type = other DNA
cttcccatttgaagaggggattga

SEQ ID NO: 41164 - DNA, 22 bp, synthetic construct
  misc_feature 1..22: note = Synthetic Construct
  source 1..22: mol_type = other DNA
gtgctggtacctgttgcctcta

SEQ ID NO: 41165 - DNA, 23 bp, synthetic construct
  misc_feature 1..23: note = Synthetic Construct
  source 1..23: mol_type = other DNA
gctcatggtgtcaggggtagtga

SEQ ID NO: 41166 - DNA, 25 bp, synthetic construct
  misc_feature 1..25: note = Synthetic Construct
  source 1..25: mol_type = other DNA
gccccttgaatattcctgtggacat

SEQ ID NO: 41167 - DNA, 21 bp, synthetic construct
  misc_feature 1..21: note = Synthetic Construct
  source 1..21: mol_type = other DNA
ggtcaatgccagcagatgagt

SEQ ID NO: 41168 - DNA, 22 bp, synthetic construct
  misc_feature 1..22: note = Synthetic Construct
  source 1..22: mol_type = other DNA
ggctaagtgtgggatgccaaga

SEQ ID NO: 41169 - DNA, 21 bp, synthetic construct
  misc_feature 1..21: note = Synthetic Construct
  source 1..21: mol_type = other DNA
gtgcagcatcacagagcaatg

SEQ ID NO: 41170 - DNA, 24 bp, synthetic construct
  misc_feature 1..24: note = Synthetic Construct
  source 1..24: mol_type = other DNA
gaggaaaaacagccacagggaatc

SEQ ID NO: 41171 - DNA, 23 bp, synthetic construct
  misc_feature 1..23: note = Synthetic Construct
  source 1..23: mol_type = other DNA
ctttcaagacctacgtgctgact

SEQ ID NO: 41172 - DNA, 20 bp, synthetic construct
  misc_feature 1..20: note = Synthetic Construct
  source 1..20: mol_type = other DNA
ccaggcaggtgccaacaaaa

SEQ ID NO: 41173 - DNA, 22 bp, synthetic construct
  misc_feature 1..22: note = Synthetic Construct
  source 1..22: mol_type = other DNA
gtgcaattcagatggcctcttc

SEQ ID NO: 41174 - DNA, 24 bp, synthetic construct
  misc_feature 1..24: note = Synthetic Construct
  source 1..24: mol_type = other DNA
tgcagaatcactcagcatgttcta

SEQ ID NO: 41175 - DNA, 20 bp, synthetic construct
  misc_feature 1..20: note = Synthetic Construct
  source 1..20: mol_type = other DNA
ggggcctcgttttggagttg

SEQ ID NO: 41176 - DNA, 20 bp, synthetic construct
  misc_feature 1..20: note = Synthetic Construct
  source 1..20: mol_type = other DNA
gcctgcgaaccctggaaatg

SEQ ID NO: 41177 - DNA, 24 bp, synthetic construct
  misc_feature 1..24: note = Synthetic Construct
  source 1..24: mol_type = other DNA
agtcttggcttgagtgaaatggta

SEQ ID NO: 41178 - DNA, 22 bp, synthetic construct
  misc_feature 1..22: note = Synthetic Construct
  source 1..22: mol_type = other DNA
aggggcagagaagcctagtgta

SEQ ID NO: 41179 - DNA, 22 bp, synthetic construct
  misc_feature 1..22: note = Synthetic Construct
  source 1..22: mol_type = other DNA
tctttcaggatgggccctgtag

SEQ ID NO: 41180 - DNA, 19 bp, synthetic construct
  misc_feature 1..19: note = Synthetic Construct
  source 1..19: mol_type = other DNA
ttgcaaagcccgggagtgt

SEQ ID NO: 41181 - DNA, 25 bp, synthetic construct
  misc_feature 1..25: note = Synthetic Construct
  source 1..25: mol_type = other DNA
gaccatagatcccctctcctacttg

SEQ ID NO: 41182 - DNA, 24 bp, synthetic construct
  misc_feature 1..24: note = Synthetic Construct
  source 1..24: mol_type = other DNA
ggacgaaggtggtagcagtacaga

SEQ ID NO: 41183 - DNA, 22 bp, synthetic construct
  misc_feature 1..22: note = Synthetic Construct
  source 1..22: mol_type = other DNA
ccttcactcgggtttcctgcaa

SEQ ID NO: 41184 - DNA, 24 bp, synthetic construct
  misc_feature 1..24: note = Synthetic Construct
  source 1..24: mol_type = other DNA
tgtgaagtacaaaccaagcacttc

SEQ ID NO: 41185 - DNA, 21 bp, synthetic construct
  misc_feature 1..21: note = Synthetic Construct
  source 1..21: mol_type = other DNA
tcaccctgcccctctttctct

SEQ ID NO: 41186 - DNA, 21 bp, synthetic construct
  misc_feature 1..21: note = Synthetic Construct
  source 1..21: mol_type = other DNA
gcactgcctcagctcctttca

SEQ ID NO: 41187 - DNA, 25 bp, synthetic construct
  misc_feature 1..25: note = Synthetic Construct
  source 1..25: mol_type = other DNA
catctcctagagctggagactgtat

SEQ ID NO: 41188 - DNA, 22 bp, synthetic construct
  misc_feature 1..22: note = Synthetic Construct
  source 1..22: mol_type = other DNA
tgacaccagatgcccctctctt

SEQ ID NO: 41189 - DNA, 22 bp, synthetic construct
  misc_feature 1..22: note = Synthetic Construct
  source 1..22: mol_type = other DNA
catgtctgtacagcagcccttt

SEQ ID NO: 41190 - DNA, 22 bp, synthetic construct
  misc_feature 1..22: note = Synthetic Construct
  source 1..22: mol_type = other DNA
ccacatccaaagagcagagctt

SEQ ID NO: 41191 - DNA, 26 bp, synthetic construct
  misc_feature 1..26: note = Synthetic Construct
  source 1..26: mol_type = other DNA
gcaaaatataggatggcctcgggttt

SEQ ID NO: 41192 - DNA, 20 bp, synthetic construct
  misc_feature 1..20: note = Synthetic Construct
  source 1..20: mol_type = other DNA
ttggggagcaagcaccttac

SEQ ID NO: 41193 - DNA, 22 bp, synthetic construct
  misc_feature 1..22: note = Synthetic Construct
  source 1..22: mol_type = other DNA
cacaccacttctctgtgaccat

SEQ ID NO: 41194 - DNA, 20 bp, synthetic construct
  misc_feature 1..20: note = Synthetic Construct
  source 1..20: mol_type = other DNA
taggtcggggagctgagaca

SEQ ID NO: 41195 - DNA, 20 bp, synthetic construct
  misc_feature 1..20: note = Synthetic Construct
  source 1..20: mol_type = other DNA
aaaccagcccgtcacacttg

SEQ ID NO: 41196 - DNA, 22 bp, synthetic construct
  misc_feature 1..22: note = Synthetic Construct
  source 1..22: mol_type = other DNA
ccccaaaccatcttcagctctt

SEQ ID NO: 41197 - DNA, 20 bp, synthetic construct
  misc_feature 1..20: note = Synthetic Construct
  source 1..20: mol_type = other DNA
tttgggtcaggggtctcctt

SEQ ID NO: 41198 - DNA, 24 bp, synthetic construct
  misc_feature 1..24: note = Synthetic Construct
  source 1..24: mol_type = other DNA
caggtgacaaaccttcctggatgt

SEQ ID NO: 41199 - DNA, 24 bp, synthetic construct
  misc_feature 1..24: note = Synthetic Construct
  source 1..24: mol_type = other DNA
caataaaaccttttccgggtcaca

SEQ ID NO: 41200 - DNA, 22 bp, synthetic construct
  misc_feature 1..22: note = Synthetic Construct
  source 1..22: mol_type = other DNA
actgaatgggtcccactgttac

SEQ ID NO: 41201 - DNA, 22 bp, synthetic construct
  misc_feature 1..22: note = Synthetic Construct
  source 1..22: mol_type = other DNA
gctcagggtgtggagtcaaaca

SEQ ID NO: 41202 - DNA, 27 bp, synthetic construct
  misc_feature 1..27: note = Synthetic Construct
  source 1..27: mol_type = other DNA
cgtgtcctttagaggatgaaaagaaac

SEQ ID NO: 41203 - DNA, 24 bp, synthetic construct
  misc_feature 1..24: note = Synthetic Construct
  source 1..24: mol_type = other DNA
tccaatgaatgtcaatggggttgt

SEQ ID NO: 41204 - DNA, 23 bp, synthetic construct
  misc_feature 1..23: note = Synthetic Construct
  source 1..23: mol_type = other DNA
ctggatttcaggggtctgctgta

SEQ ID NO: 41205 - DNA, 24 bp, synthetic construct
  misc_feature 1..24: note = Synthetic Construct
  source 1..24: mol_type = other DNA
gctgttcacagtttctggaagaca

SEQ ID NO: 41206 - DNA, 20 bp, synthetic construct
  misc_feature 1..20: note = Synthetic Construct
  source 1..20: mol_type = other DNA
tccagccattccctgcatca

SEQ ID NO: 41207 - DNA, 20 bp, synthetic construct
  misc_feature 1..20: note = Synthetic Construct
  source 1..20: mol_type = other DNA
tgtcagtgtgggcaggcaat

SEQ ID NO: 41208 - DNA, 20 bp, synthetic construct
  misc_feature 1..20: note = Synthetic Construct
  source 1..20: mol_type = other DNA
gtggggcccttctcttctct

SEQ ID NO: 41209 - DNA, 21 bp, synthetic construct
  misc_feature 1..21: note = Synthetic Construct
  source 1..21: mol_type = other DNA
tggtaagggctaggccaccaa

SEQ ID NO: 41210 - DNA, 20 bp, synthetic construct
  misc_feature 1..20: note = Synthetic Construct
  source 1..20: mol_type = other DNA
gcagctgttcccgtgactgt

SEQ ID NO: 41211 - DNA, 19 bp, synthetic construct
  misc_feature 1..19: note = Synthetic Construct
  source 1..19: mol_type = other DNA
tgcctgaagccccatgaac

SEQ ID NO: 41212 - DNA, 19 bp, synthetic construct
  misc_feature 1..19: note = Synthetic Construct
  source 1..19: mol_type = other DNA
ttgcataagggcccgcttt

SEQ ID NO: 41213 - DNA, 28 bp, synthetic construct
  misc_feature 1..28: note = Synthetic Construct
  source 1..28: mol_type = other DNA
ggaacagaacaagagagtagttgtggat

SEQ ID NO: 41214 - DNA, 23 bp, synthetic construct
  misc_feature 1..23: note = Synthetic Construct
  source 1..23: mol_type = other DNA
gcaacgcagcaatatatgctcaa

SEQ ID NO: 41215 - DNA, 22 bp, synthetic construct
  misc_feature 1..22: note = Synthetic Construct
  source 1..22: mol_type = other DNA
caccaaccccaacctagacttc

SEQ ID NO: 41216 - DNA, 20 bp, synthetic construct
  misc_feature 1..20: note = Synthetic Construct
  source 1..20: mol_type = other DNA
tacccttggggcatgcaaag

SEQ ID NO: 41217 - DNA, 20 bp, synthetic construct
  misc_feature 1..20: note = Synthetic Construct
  source 1..20: mol_type = other DNA
gccagccttgcagagaaaca

SEQ ID NO: 41218 - DNA, 26 bp, synthetic construct
  misc_feature 1..26: note = Synthetic Construct
  source 1..26: mol_type = other DNA
ccacagtccctaaatggggagtatca

SEQ ID NO: 41219 - DNA, 19 bp, synthetic construct
  misc_feature 1..19: note = Synthetic Construct
  source 1..19: mol_type = other DNA
ggtgggctctgtgctgtgt

SEQ ID NO: 41220 - DNA, 19 bp, synthetic construct
  misc_feature 1..19: note = Synthetic Construct
  source 1..19: mol_type = other DNA
ccaggtgcagagcggtgta

SEQ ID NO: 41221 - DNA, 19 bp, synthetic construct
  misc_feature 1..19: note = Synthetic Construct
  source 1..19: mol_type = other DNA
aagcctggctggcgctgaa

SEQ ID NO: 41222 - DNA, 20 bp, synthetic construct
  misc_feature 1..20: note = Synthetic Construct
  source 1..20: mol_type = other DNA
aggagccgggcattcagaga

SEQ ID NO: 41223 - DNA, 28 bp, synthetic construct
  misc_feature 1..28: note = Synthetic Construct
  source 1..28: mol_type = other DNA
gaggatccctttcctgtaactaaagtgt

SEQ ID NO: 41224 - DNA, 25 bp, synthetic construct
  misc_feature 1..25: note = Synthetic Construct
  source 1..25: mol_type = other DNA
gtgtataaagccagaccaacgatgt

SEQ ID NO: 41225 - DNA, 20 bp, synthetic construct
  misc_feature 1..20: note = Synthetic Construct
  source 1..20: mol_type = other DNA
tggcaggacgtggtgtccat

SEQ ID NO: 41226 - DNA, 20 bp, synthetic construct
  misc_feature 1..20: note = Synthetic Construct
  source 1..20: mol_type = other DNA
ccgcaacctctcggggattt

SEQ ID NO: 41227 - DNA, 20 bp, synthetic construct
  misc_feature 1..20: note = Synthetic Construct
  source 1..20: mol_type = other DNA
ggaggccaccattccacgat

SEQ ID NO: 41228 - DNA, 20 bp, synthetic construct
  misc_feature 1..20: note = Synthetic Construct
  source 1..20: mol_type = other DNA
gatgccaaccgatgcctttg

SEQ ID NO: 41229 - DNA, 25 bp, synthetic construct
  misc_feature 1..25: note = Synthetic Construct
  source 1..25: mol_type = other DNA
gttatgaattgcaagaccccatgaa

SEQ ID NO: 41230 - DNA, 20 bp, synthetic construct
  misc_feature 1..20: note = Synthetic Construct
  source 1..20: mol_type = other DNA
cagaggcagctgcaccattt

SEQ ID NO: 41231 - DNA, 20 bp, synthetic construct
  misc_feature 1..20: note = Synthetic Construct
  source 1..20: mol_type = other DNA
tcagctgacagggccaaaac

SEQ ID NO: 41232 - DNA, 23 bp, synthetic construct
  misc_feature 1..23: note = Synthetic Construct
  source 1..23: mol_type = other DNA
ctctcagagcccaaactcattgt

SEQ ID NO: 41233 - DNA, 20 bp, synthetic construct
  misc_feature 1..20: note = Synthetic Construct
  source 1..20: mol_type = other DNA
tgggctgtggaaaggtcatc

SEQ ID NO: 41234 - DNA, 22 bp, synthetic construct
  misc_feature 1..22: note = Synthetic Construct
  source 1..22: mol_type = other DNA
agcaacggaaggaactcacatc

SEQ ID NO: 41235 - DNA, 19 bp, synthetic construct
  misc_feature 1..19: note = Synthetic Construct
  source 1..19: mol_type = other DNA
ccagttggccctgctgaaa

SEQ ID NO: 41236 - DNA, 19 bp, synthetic construct
  misc_feature 1..19: note = Synthetic Construct
  source 1..19: mol_type = other DNA
tggccgtcagcgtccactt

SEQ ID NO: 41237 - DNA, 18 bp, synthetic construct
  misc_feature 1..18: note = Synthetic Construct
  source 1..18: mol_type = other DNA
gcgtgtagcgcaggtagt

SEQ ID NO: 41238 - DNA, 22 bp, synthetic construct
  misc_feature 1..22: note = Synthetic Construct
  source 1..22: mol_type = other DNA
ctccaggaagtttcccttgtgt

SEQ ID NO: 41239 - DNA, 22 bp, synthetic construct
  misc_feature 1..22: note = Synthetic Construct
  source 1..22: mol_type = other DNA
cctcctgtcttggttggcttgt

SEQ ID NO: 41240 - DNA, 24 bp, synthetic construct
  misc_feature 1..24: note = Synthetic Construct
  source 1..24: mol_type = other DNA
ccaccagtgcacttagtgatgctt

SEQ ID NO: 41241 - DNA, 21 bp, synthetic construct
  misc_feature 1..21: note = Synthetic Construct
  source 1..21: mol_type = other DNA
gctgggacacaccttccgaat

SEQ ID NO: 41242 - DNA, 20 bp, synthetic construct
  misc_feature 1..20: note = Synthetic Construct
  source 1..20: mol_type = other DNA
tgccgggtgctctgctagat

SEQ ID NO: 41243 - DNA, 27 bp, synthetic construct
  misc_feature 1..27: note = Synthetic Construct
  source 1..27: mol_type = other DNA
cagttatttgtctgggaagaggtggat

SEQ ID NO: 41244 - DNA, 20 bp, synthetic construct
  misc_feature 1..20: note = Synthetic Construct
  source 1..20: mol_type = other DNA
gagggagggagggaatgtga

SEQ ID NO: 41245 - DNA, 20 bp, synthetic construct
  misc_feature 1..20: note = Synthetic Construct
  source 1..20: mol_type = other DNA
acccggcttcccagtgctta

SEQ ID NO: 41246 - DNA, 27 bp, synthetic construct
  misc_feature 1..27: note = Synthetic Construct
  source 1..27: mol_type = other DNA
gtgaaagaaatctcagaggctttgact

SEQ ID NO: 41247 - DNA, 22 bp, synthetic construct
  misc_feature 1..22: note = Synthetic Construct
  source 1..22: mol_type = other DNA
tcttcttgaggcccatgtcaac

SEQ ID NO: 41248 - DNA, 27 bp, synthetic construct
  misc_feature 1..27: note = Synthetic Construct
  source 1..27: mol_type = other DNA
gccaacttccttttgttggatcctttc

SEQ ID NO: 41249 - DNA, 22 bp, synthetic construct
  misc_feature 1..22: note = Synthetic Construct
  source 1..22: mol_type = other DNA
accaccttgcctcagaccctat

SEQ ID NO: 41250 - DNA, 26 bp, synthetic construct
  misc_feature 1..26: note = Synthetic Construct
  source 1..26: mol_type = other DNA
ggtgaagcagcatcttagaggggtat

SEQ ID NO: 41251 - DNA, 19 bp, synthetic construct
  misc_feature 1..19: note = Synthetic Construct
  source 1..19: mol_type = other DNA
ggtggcccgaactctccat

SEQ ID NO: 41252 - DNA, 20 bp, synthetic construct
  misc_feature 1..20: note = Synthetic Construct
  source 1..20: mol_type = other DNA
ccgtggatgtgggctagttt

SEQ ID NO: 41253 - DNA, 20 bp, synthetic construct
  misc_feature 1..20: note = Synthetic Construct
  source 1..20: mol_type = other DNA
tccacctgcgctggagtatg

SEQ ID NO: 41254 - DNA, 20 bp, synthetic construct
  misc_feature 1..20: note = Synthetic Construct
  source 1..20: mol_type = other DNA
tgtacccagtgccgactgtt

SEQ ID NO: 41255 - DNA, 21 bp, synthetic construct
  misc_feature 1..21: note = Synthetic Construct
  source 1..21: mol_type = other DNA
ccatggagaccactggaggtt

SEQ ID NO: 41256 - DNA, 25 bp, synthetic construct
  misc_feature 1..25: note = Synthetic Construct
  source 1..25: mol_type = other DNA
tctaaaactacctgagccacagttg

SEQ ID NO: 41257 - DNA, 21 bp, synthetic construct
  misc_feature 1..21: note = Synthetic Construct
  source 1..21: mol_type = other DNA
gccaggctcttgactcccaat

SEQ ID NO: 41258 - DNA, 23 bp, synthetic construct
  misc_feature 1..23: note = Synthetic Construct
  source 1..23: mol_type = other DNA
gtcgtctgcctcgatgacttttc

SEQ ID NO: 41259 - DNA, 21 bp, synthetic construct
  misc_feature 1..21: note = Synthetic Construct
  source 1..21: mol_type = other DNA
ggttgtggcatgggcatcatt

SEQ ID NO: 41260 - DNA, 18 bp, synthetic construct
  misc_feature 1..18: note = Synthetic Construct
  source 1..18: mol_type = other DNA
acctgcgtccctgcagaa

SEQ ID NO: 41261 - DNA, 20 bp, synthetic construct
  misc_feature 1..20: note = Synthetic Construct
  source 1..20: mol_type = other DNA
tgtcttgctgccacctgaga

SEQ ID NO: 41262 - DNA, 21 bp, synthetic construct
  misc_feature 1..21: note = Synthetic Construct
  source 1..21: mol_type = other DNA
agcctctccagctgggcttat

SEQ ID NO: 41263 - DNA, 25 bp, synthetic construct
  misc_feature 1..25: note = Synthetic Construct
  source 1..25: mol_type = other DNA
tggtgaggaataaagggagacaaac

SEQ ID NO: 41264 - DNA, 24 bp, synthetic construct
  misc_feature 1..24: note = Synthetic Construct
  source 1..24: mol_type = other DNA
aagaagtcactggaaagcacattg

SEQ ID NO: 41265 - DNA, 19 bp, synthetic construct
  misc_feature 1..19: note = Synthetic Construct
  source 1..19: mol_type = other DNA
tggtcccaggcccacacat

SEQ ID NO: 41266 - DNA, 24 bp, synthetic construct
  misc_feature 1..24: note = Synthetic Construct
  source 1..24: mol_type = other DNA
acagtaatggcttgatctgctgtt

SEQ ID NO: 41267 - DNA, 23 bp, synthetic construct
  misc_feature 1..23: note = Synthetic Construct
  source 1..23: mol_type = other DNA
accttcacaggatcatcccaaag

SEQ ID NO: 41268 - DNA, 21 bp, synthetic construct
  misc_feature 1..21: note = Synthetic Construct
  source 1..21: mol_type = other DNA
tacggtgtccagtggggcatt

SEQ ID NO: 41269 - DNA, 22 bp, synthetic construct
  misc_feature 1..22: note = Synthetic Construct
  source 1..22: mol_type = other DNA
gcctatcacttggaggcctttc

SEQ ID NO: 41270 - DNA, 21 bp, synthetic construct
  misc_feature 1..21: note = Synthetic Construct
  source 1..21: mol_type = other DNA
ggcacgagacttggtgtgtga

SEQ ID NO: 41271 - DNA, 22 bp, synthetic construct
  misc_feature 1..22: note = Synthetic Construct
  source 1..22: mol_type = other DNA
ctttgcaacccctccagagaag

SEQ ID NO: 41272 - DNA, 18 bp, synthetic construct
  misc_feature 1..18: note = Synthetic Construct
  source 1..18: mol_type = other DNA
tgcgcacagagcgaaagt

SEQ ID NO: 41273 - DNA, 20 bp, synthetic construct
  misc_feature 1..20: note = Synthetic Construct
  source 1..20: mol_type = other DNA
agcctctgggcacagtgaac

SEQ ID NO: 41274 - DNA, 23 bp, synthetic construct
  misc_feature 1..23: note = Synthetic Construct
  source 1..23: mol_type = other DNA
gccatctctttactgaccagctt

SEQ ID NO: 41275 - DNA, 25 bp, synthetic construct
  misc_feature 1..25: note = Synthetic Construct
  source 1..25: mol_type = other DNA
gctgttctttcccatacacgtcact

SEQ ID NO: 41276 - DNA, 20 bp, synthetic construct
  misc_feature 1..20: note = Synthetic Construct
  source 1..20: mol_type = other DNA
tggaatccgtgaggccaaga

SEQ ID NO: 41277 - DNA, 23 bp, synthetic construct
  misc_feature 1..23: note = Synthetic Construct
  source 1..23: mol_type = other DNA
ctgaaactgtgtggtagcagcaa

SEQ ID NO: 41278 - DNA, 19 bp, synthetic construct
  misc_feature 1..19: note = Synthetic Construct
  source 1..19: mol_type = other DNA
acagggctggcacacacaa

SEQ ID NO: 41279 - DNA, 21 bp, synthetic construct
  misc_feature 1..21: note = Synthetic Construct
  source 1..21: mol_type = other DNA
gggctcttagccttggaggat

SEQ ID NO: 41280 - DNA, 22 bp, synthetic construct
  misc_feature 1..22: note = Synthetic Construct
  source 1..22: mol_type = other DNA
ccttggagctgctgggaaagtt

SEQ ID NO: 41281 - DNA, 19 bp, synthetic construct
  misc_feature 1..19: note = Synthetic Construct
  source 1..19: mol_type = other DNA
agccccaccgttgtctgta

SEQ ID NO: 41282 - DNA, 22 bp, synthetic construct
  misc_feature 1..22: note = Synthetic Construct
  source 1..22: mol_type = other DNA
caggtgtcatctctgtggcaat

SEQ ID NO: 41283 - DNA, 20 bp, synthetic construct
  misc_feature 1..20: note = Synthetic Construct
  source 1..20: mol_type = other DNA
gagacaatgctgccgggaaa

SEQ ID NO: 41284 - DNA, 21 bp, synthetic construct
  misc_feature 1..21: note = Synthetic Construct
  source 1..21: mol_type = other DNA
gctttgctccggcagtgatct

SEQ ID NO: 41285 - DNA, 20 bp, synthetic construct
  misc_feature 1..20: note = Synthetic Construct
  source 1..20: mol_type = other DNA
tccaagcgcgcagactgtat

SEQ ID NO: 41286 - DNA, 25 bp, synthetic construct
  misc_feature 1..25: note = Synthetic Construct
  source 1..25: mol_type = other DNA
cccattgaaaactctccctgctatg

SEQ ID NO: 41287 - DNA, 28 bp, synthetic construct
  misc_feature 1..28: note = Synthetic Construct
  source 1..28: mol_type = other DNA
cacctgctggtgatatatgacttcaaac

SEQ ID NO: 41288 - DNA, 22 bp, synthetic construct
  misc_feature 1..22: note = Synthetic Construct
  source 1..22: mol_type = other DNA
ccaggaaggagtctggtgttgt

SEQ ID NO: 41289 - DNA, 21 bp, synthetic construct
  misc_feature 1..21: note = Synthetic Construct
  source 1..21: mol_type = other DNA
gcgactgtcacggacacttct

SEQ ID NO: 41290 - DNA, 22 bp, synthetic construct
  misc_feature 1..22: note = Synthetic Construct
  source 1..22: mol_type = other DNA
ctcaccagaggcacatcgtttc

SEQ ID NO: 41291 - DNA, 25 bp, synthetic construct
  misc_feature 1..25: note = Synthetic Construct
  source 1..25: mol_type = other DNA
cctggttctttctctccctcctgtt

SEQ ID NO: 41292 - DNA, 22 bp, synthetic construct
  misc_feature 1..22: note = Synthetic Construct
  source 1..22: mol_type = other DNA
agctcaagggacagcccaaatc

SEQ ID NO: 41293 - DNA, 22 bp, synthetic construct
  misc_feature 1..22: note = Synthetic Construct
  source 1..22: mol_type = other DNA
ggcaaaggcaggcagaaagcaa

SEQ ID NO: 41294 - DNA, 20 bp, synthetic construct
  misc_feature 1..20: note = Synthetic Construct
  source 1..20: mol_type = other DNA
tccctgacagccgcctcaat

SEQ ID NO: 41295 - DNA, 24 bp, synthetic construct
  misc_feature 1..24: note = Synthetic Construct
  source 1..24: mol_type = other DNA
gggactcacaaactgctattgttc

SEQ ID NO: 41296 - DNA, 22 bp, synthetic construct
  misc_feature 1..22: note = Synthetic Construct
  source 1..22: mol_type = other DNA
gctctgccaagagctggcttta

SEQ ID NO: 41297 - DNA, 26 bp, synthetic construct
  misc_feature 1..26: note = Synthetic Construct
  source 1..26: mol_type = other DNA
tccaacctctaggattttcctctaca

SEQ ID NO: 41298 - DNA, 20 bp, synthetic construct
  misc_feature 1..20: note = Synthetic Construct
  source 1..20: mol_type = other DNA
gctggcaactgcttgtgaga

SEQ ID NO: 41299 - DNA, 20 bp, synthetic construct
  misc_feature 1..20: note = Synthetic Construct
  source 1..20: mol_type = other DNA
aggctgcttggccatgttct

SEQ ID NO: 41300 - DNA, 25 bp, synthetic construct
  misc_feature 1..25: note = Synthetic Construct
  source 1..25: mol_type = other DNA
cccttgaaaatacctggttgcttct

SEQ ID NO: 41301 - DNA, 20 bp, synthetic construct
  misc_feature 1..20: note = Synthetic Construct
  source 1..20: mol_type = other DNA
gagaagaatgcccgctctgt

SEQ ID NO: 41302 - DNA, 27 bp, synthetic construct
  misc_feature 1..27: note = Synthetic Construct
  source 1..27: mol_type = other DNA
cccagatggagctgaaaagaggaattg

SEQ ID NO: 41303 - DNA, 22 bp, synthetic construct
  misc_feature 1..22: note = Synthetic Construct
  source 1..22: mol_type = other DNA
ggggtccagcactattctcttg

SEQ ID NO: 41304 - DNA, 22 bp, synthetic construct
  misc_feature 1..22: note = Synthetic Construct
  source 1..22: mol_type = other DNA
cgaggttgtcggaagggacttt

SEQ ID NO: 41305 - DNA, 20 bp, synthetic construct
  misc_feature 1..20: note = Synthetic Construct
  source 1..20: mol_type = other DNA
ccaaggactcccagcacctt

SEQ ID NO: 41306 - DNA, 20 bp, synthetic construct
  misc_feature 1..20: note = Synthetic Construct
  source 1..20: mol_type = other DNA
aatgtcaggcagcccagaga

SEQ ID NO: 41307 - DNA, 20 bp, synthetic construct
  misc_feature 1..20: note = Synthetic Construct
  source 1..20: mol_type = other DNA
aaccggtggatcctgctttc

SEQ ID NO: 41308 - DNA, 22 bp, synthetic construct
  misc_feature 1..22: note = Synthetic Construct
  source 1..22: mol_type = other DNA
agtccctccctggagttctttg

SEQ ID NO: 41309 - DNA, 24 bp, synthetic construct
  misc_feature 1..24: note = Synthetic Construct
  source 1..24: mol_type = other DNA
tggagaatttgttgtggtggtgtt

SEQ ID NO: 41310 - DNA, 25 bp, synthetic construct
  misc_feature 1..25: note = Synthetic Construct
  source 1..25: mol_type = other DNA
aagttacatcttccaaaccccagat

SEQ ID NO: 41311 - DNA, 25 bp, synthetic construct
  misc_feature 1..25: note = Synthetic Construct
  source 1..25: mol_type = other DNA
gacagaatccaaatcctgcccttag

SEQ ID NO: 41312 - DNA, 20 bp, synthetic construct
  misc_feature 1..20: note = Synthetic Construct
  source 1..20: mol_type = other DNA
cgagggtgacccctgattga

SEQ ID NO: 41313 - DNA, 25 bp, synthetic construct
  misc_feature 1..25: note = Synthetic Construct
  source 1..25: mol_type = other DNA
ccaactggtgtcttctgtctacttg

SEQ ID NO: 41314 - DNA, 24 bp, synthetic construct
  misc_feature 1..24: note = Synthetic Construct
  source 1..24: mol_type = other DNA
gcttctgtccctcaggacctttga

SEQ ID NO: 41315 - DNA, 21 bp, synthetic construct
  misc_feature 1..21: note = Synthetic Construct
  source 1..21: mol_type = other DNA
tccttctccagctgctgtttc

SEQ ID NO: 41316 - DNA, 22 bp, synthetic construct
  misc_feature 1..22: note = Synthetic Construct
  source 1..22: mol_type = other DNA
ctctcttttcccaggtgtgtgt

SEQ ID NO: 41317 - DNA, 23 bp, synthetic construct
  misc_feature 1..23: note = Synthetic Construct
  source 1..23: mol_type = other DNA
gggtagaggccatggagacaaac

SEQ ID NO: 41318 - DNA, 25 bp, synthetic construct
  misc_feature 1..25: note = Synthetic Construct
  source 1..25: mol_type = other DNA
ccataagaaagaaggacctgtgtga

SEQ ID NO: 41319 - DNA, 24 bp, synthetic construct
  misc_feature 1..24: note = Synthetic Construct
  source 1..24: mol_type = other DNA
gcccagctttggactggtctaagt

SEQ ID NO: 41320 - DNA, 20 bp, synthetic construct
  misc_feature 1..20: note = Synthetic Construct
  source 1..20: mol_type = other DNA
tctgggtcagagcaggacaa

SEQ ID NO: 41321 - DNA, 22 bp, synthetic construct
  misc_feature 1..22: note = Synthetic Construct
  source 1..22: mol_type = other DNA
cctgctgcttcggactgatttc

SEQ ID NO: 41322 - DNA, 22 bp, synthetic construct
  misc_feature 1..22: note = Synthetic Construct
  source 1..22: mol_type = other DNA
cgttacacgcagtagcgagttg

SEQ ID NO: 41323 - DNA, 20 bp, synthetic construct
  misc_feature 1..20: note = Synthetic Construct
  source 1..20: mol_type = other DNA
gcccaggaaccacagtgcaa

SEQ ID NO: 41324 - DNA, 21 bp, synthetic construct
  misc_feature 1..21: note = Synthetic Construct
  source 1..21: mol_type = other DNA
cctacaagggtggctggtctt

SEQ ID NO: 41325 - DNA, 19 bp, synthetic construct
  misc_feature 1..19: note = Synthetic Construct
  source 1..19: mol_type = other DNA
tgctgtggcactggcattt

SEQ ID NO: 41326 - DNA, 22 bp, synthetic construct
  misc_feature 1..22: note = Synthetic Construct
  source 1..22: mol_type = other DNA
gctctaggcctcatgtccagaa

SEQ ID NO: 41327 - DNA, 27 bp, synthetic construct
  misc_feature 1..27: note = Synthetic Construct
  source 1..27: mol_type = other DNA
tctcagaagaaggaaagaggagtatgt

SEQ ID NO: 41328 - DNA, 22 bp, synthetic construct
  misc_feature 1..22: note = Synthetic Construct
  source 1..22: mol_type = other DNA
tcctgtgcgactctgcttctct

SEQ ID NO: 41329 - DNA, 21 bp, synthetic construct
  misc_feature 1..21: note = Synthetic Construct
  source 1..21: mol_type = other DNA
atcgatggctccccggtcatt

SEQ ID NO: 41330 - DNA, 20 bp, synthetic construct
  misc_feature 1..20: note = Synthetic Construct
  source 1..20: mol_type = other DNA
actgtcacatccggggctat

SEQ ID NO: 41331 - DNA, 23 bp, synthetic construct
  misc_feature 1..23: note = Synthetic Construct
  source 1..23: mol_type = other DNA
gatcacactactgcctcttggaa

SEQ ID NO: 41332 - DNA, 21 bp, synthetic construct
  misc_feature 1..21: note = Synthetic Construct
  source 1..21: mol_type = other DNA
acagagagcttcaccccgaaa

SEQ ID NO: 41333 - DNA, 25 bp, synthetic construct
  misc_feature 1..25: note = Synthetic Construct
  source 1..25: mol_type = other DNA
tcccagattgtcagactccataagt

SEQ ID NO: 41334 - DNA, 18 bp, synthetic construct
  misc_feature 1..18: note = Synthetic Construct
  source 1..18: mol_type = other DNA
gcgccaacaccagagcat

SEQ ID NO: 41335 - DNA, 22 bp, synthetic construct
  misc_feature 1..22: note = Synthetic Construct
  source 1..22: mol_type = other DNA
gggtcacctgtacttgggtttg

SEQ ID NO: 41336 - DNA, 19 bp, synthetic construct
  misc_feature 1..19: note = Synthetic Construct
  source 1..19: mol_type = other DNA
ggtgggtgcagcccaagat

SEQ ID NO: 41337 - DNA, 22 bp, synthetic construct
  misc_feature 1..22: note = Synthetic Construct
  source 1..22: mol_type = other DNA
gggtctcagctggttcgtttca

SEQ ID NO: 41338 - DNA, 24 bp, synthetic construct
  misc_feature 1..24: note = Synthetic Construct
  source 1..24: mol_type = other DNA
ggccctttcgtactaccacgtatc

SEQ ID NO: 41339 - DNA, 20 bp, synthetic construct
  misc_feature 1..20: note = Synthetic Construct
  source 1..20: mol_type = other DNA
caccctgcctgcctctaaaa

SEQ ID NO: 41340 - DNA, 22 bp, synthetic construct
  misc_feature 1..22: note = Synthetic Construct
  source 1..22: mol_type = other DNA
ttctgcttaaaccaggccaaga

SEQ ID NO: 41341 - DNA, 21 bp, synthetic construct
  misc_feature 1..21: note = Synthetic Construct
  source 1..21: mol_type = other DNA
ggccacgaaatgcatgcttga

SEQ ID NO: 41342 - DNA, 20 bp, synthetic construct
  misc_feature 1..20: note = Synthetic Construct
  source 1..20: mol_type = other DNA
gttccatccgctgtccagtt

SEQ ID NO: 41343 - DNA, 27 bp, synthetic construct
  misc_feature 1..27: note = Synthetic Construct
  source 1..27: mol_type = other DNA
gtcaccagtaccttctataagccttga

SEQ ID NO: 41344 - DNA, 25 bp, synthetic construct
  misc_feature 1..25: note = Synthetic Construct
  source 1..25: mol_type = other DNA
ggatgaaccccttctacaggtaaca

SEQ ID NO: 41345 - DNA, 22 bp, synthetic construct
  misc_feature 1..22: note = Synthetic Construct
  source 1..22: mol_type = other DNA
accaaattcaacagcgcactac

SEQ ID NO: 41346 - DNA, 20 bp, synthetic construct
  misc_feature 1..20: note = Synthetic Construct
  source 1..20: mol_type = other DNA
ccacacctcagtccctgtga

SEQ ID NO: 41347 - DNA, 24 bp, synthetic construct
  misc_feature 1..24: note = Synthetic Construct
  source 1..24: mol_type = other DNA
gctctgcacttcatccttccttag

SEQ ID NO: 41348 - DNA, 22 bp, synthetic construct
  misc_feature 1..22: note = Synthetic Construct
  source 1..22: mol_type = other DNA
gggccttcatgctgtgtcattg

SEQ ID NO: 41349 - DNA, 22 bp, synthetic construct
  misc_feature 1..22: note = Synthetic Construct
  source 1..22: mol_type = other DNA
tctggagttcctgggacaaaac

SEQ ID NO: 41350 - DNA, 21 bp, synthetic construct
  misc_feature 1..21: note = Synthetic Construct
  source 1..21: mol_type = other DNA
ggcagctggaagacagagtgt

SEQ ID NO: 41351 - DNA, 22 bp, synthetic construct
  misc_feature 1..22: note = Synthetic Construct
  source 1..22: mol_type = other DNA
gcacaatcagcaactgggacaa

SEQ ID NO: 41352 - DNA, 21 bp, synthetic construct
  misc_feature 1..21: note = Synthetic Construct
  source 1..21: mol_type = other DNA
tcctccactggactgcggaat

SEQ ID NO: 41353 - DNA, 23 bp, synthetic construct
  misc_feature 1..23: note = Synthetic Construct
  source 1..23: mol_type = other DNA
cctgctctgcatttccactggtt

SEQ ID NO: 41354 - DNA, 23 bp, synthetic construct
  misc_feature 1..23: note = Synthetic Construct
  source 1..23: mol_type = other DNA
tttcagggagtcatgggctattg

SEQ ID NO: 41355 - DNA, 21 bp, synthetic construct
  misc_feature 1..21: note = Synthetic Construct
  source 1..21: mol_type = other DNA
atcctgtcggggtgggtgctt

SEQ ID NO: 41356 - DNA, 26 bp, synthetic construct
  misc_feature 1..26: note = Synthetic Construct
  source 1..26: mol_type = other DNA
tgacctcatctattctggctgttaga

SEQ ID NO: 41357 - DNA, 21 bp, synthetic construct
  misc_feature 1..21: note = Synthetic Construct
  source 1..21: mol_type = other DNA
caacactgcagcttggcctta

SEQ ID NO: 41358 - DNA, 25 bp, synthetic construct
  misc_feature 1..25: note = Synthetic Construct
  source 1..25: mol_type = other DNA
tgatctagagaaaggggaaggctat

SEQ ID NO: 41359 - DNA, 21 bp, synthetic construct
  misc_feature 1..21: note = Synthetic Construct
  source 1..21: mol_type = other DNA
agcctgcctatcacccatact

SEQ ID NO: 41360 - DNA, 23 bp, synthetic construct
  misc_feature 1..23: note = Synthetic Construct
  source 1..23: mol_type = other DNA
ctccatggaaaccaacctctcaa

SEQ ID NO: 41361 - DNA, 20 bp, synthetic construct
  misc_feature 1..20: note = Synthetic Construct
  source 1..20: mol_type = other DNA
tctggggctcaagctgttct

SEQ ID NO: 41362 - DNA, 26 bp, synthetic construct
  misc_feature 1..26: note = Synthetic Construct
  source 1..26: mol_type = other DNA
gagagtgaggaaaaaccaagacctta

SEQ ID NO: 41363 - DNA, 24 bp, synthetic construct
  misc_feature 1..24: note = Synthetic Construct
  source 1..24: mol_type = other DNA
gggctgtgcttccatcttgccata

SEQ ID NO: 41364 - DNA, 20 bp, synthetic construct
  misc_feature 1..20: note = Synthetic Construct
  source 1..20: mol_type = other DNA
tctcacacacctggcctcaa

SEQ ID NO: 41365 - DNA, 22 bp, synthetic construct
  misc_feature 1..22: note = Synthetic Construct
  source 1..22: mol_type = other DNA
ccagccttggtctgtcttgctt

SEQ ID NO: 41366 - DNA, 21 bp, synthetic construct
  misc_feature 1..21: note = Synthetic Construct
  source 1..21: mol_type = other DNA
agcacctccaggtcacaaatc

SEQ ID NO: 41367 - DNA, 18 bp, synthetic construct
  misc_feature 1..18: note = Synthetic Construct
  source 1..18: mol_type = other DNA
tccgggactgtgggcaaa

SEQ ID NO: 41368 - DNA, 22 bp, synthetic construct
  misc_feature 1..22: note = Synthetic Construct
  source 1..22: mol_type = other DNA
ggtgtttctggagggctgacaa

SEQ ID NO: 41369 - DNA, 25 bp, synthetic construct
  misc_feature 1..25: note = Synthetic Construct
  source 1..25: mol_type = other DNA
cttcatacacctccatttgctgagt

SEQ ID NO: 41370 - DNA, 25 bp, synthetic construct
  misc_feature 1..25: note = Synthetic Construct
  source 1..25: mol_type = other DNA
ccaagttgccaaagaatgcctgact

SEQ ID NO: 41371 - DNA, 20 bp, synthetic construct
  misc_feature 1..20: note = Synthetic Construct
  source 1..20: mol_type = other DNA
cctgctagtgctgcttggtt

SEQ ID NO: 41372 - DNA, 21 bp, synthetic construct
  misc_feature 1..21: note = Synthetic Construct
  source 1..21: mol_type = other DNA
catgtgctttgcagggagtct

SEQ ID NO: 41373 - DNA, 22 bp, synthetic construct
  misc_feature 1..22: note = Synthetic Construct
  source 1..22: mol_type = other DNA
tcacgggtctagcctctgtttc

SEQ ID NO: 41374 - DNA, 18 bp, synthetic construct
  misc_feature 1..18: note = Synthetic Construct
  source 1..18: mol_type = other DNA
tggcctttgggcgtcaat

SEQ ID NO: 41375 - DNA, 23 bp, synthetic construct
  misc_feature 1..23: note = Synthetic Construct
  source 1..23: mol_type = other DNA
cctagtaaggaggaacgggattg

SEQ ID NO: 41376 - DNA, 25 bp, synthetic construct
  misc_feature 1..25: note = Synthetic Construct
  source 1..25: mol_type = other DNA
cagctcagaagtaagactcccagat

SEQ ID NO: 41377 - DNA, 21 bp, synthetic construct
  misc_feature 1..21: note = Synthetic Construct
  source 1..21: mol_type = other DNA
gaggacagcactccaaggttt

SEQ ID NO: 41378 - DNA, 21 bp, synthetic construct
  misc_feature 1..21: note = Synthetic Construct
  source 1..21: mol_type = other DNA
tgtagcacactgcaacagtca

SEQ ID NO: 41379 - DNA, 24 bp, synthetic construct
  misc_feature 1..24: note = Synthetic Construct
  source 1..24: mol_type = other DNA
ctcactacatccacagtccaggaa

SEQ ID NO: 41380 - DNA, 25 bp, synthetic construct
  misc_feature 1..25: note = Synthetic Construct
  source 1..25: mol_type = other DNA
tccttcagagatcagagaagctttg

SEQ ID NO: 41381 - DNA, 22 bp, synthetic construct
  misc_feature 1..22: note = Synthetic Construct
  source 1..22: mol_type = other DNA
ggtgcctgaaagagccagtgtt

SEQ ID NO: 41382 - DNA, 25 bp, synthetic construct
  misc_feature 1..25: note = Synthetic Construct
  source 1..25: mol_type = other DNA
gacatctgagttaactggcaccaaa

SEQ ID NO: 41383 - DNA, 23 bp, synthetic construct
  misc_feature 1..23: note = Synthetic Construct
  source 1..23: mol_type = other DNA
cacacgacacacacatgaacttg

SEQ ID NO: 41384 - DNA, 24 bp, synthetic construct
  misc_feature 1..24: note = Synthetic Construct
  source 1..24: mol_type = other DNA
ggcccacatcactttgggcaaaac

SEQ ID NO: 41385 - DNA, 21 bp, synthetic construct
  misc_feature 1..21: note = Synthetic Construct
  source 1..21: mol_type = other DNA
atgcaggctgacctcccatct

SEQ ID NO: 41386 - DNA, 22 bp, synthetic construct
  misc_feature 1..22: note = Synthetic Construct
  source 1..22: mol_type = other DNA
gaacaaatgcatgcagccaagt

SEQ ID NO: 41387 - DNA, 22 bp, synthetic construct
  misc_feature 1..22: note = Synthetic Construct
  source 1..22: mol_type = other DNA
ccaccctgcagacctcttacat

SEQ ID NO: 41388 - DNA, 20 bp, synthetic construct
  misc_feature 1..20: note = Synthetic Construct
  source 1..20: mol_type = other DNA
agggactggaagagcactgt

SEQ ID NO: 41389 - DNA, 24 bp, synthetic construct
  misc_feature 1..24: note = Synthetic Construct
  source 1..24: mol_type = other DNA
atcaaagacctggcaagaatcaga

SEQ ID NO: 41390 - DNA, 19 bp, synthetic construct
  misc_feature 1..19: note = Synthetic Construct
  source 1..19: mol_type = other DNA
tgctggcaccagggcctaa

SEQ ID NO: 41391 - DNA, 22 bp, synthetic construct
  misc_feature 1..22: note = Synthetic Construct
  source 1..22: mol_type = other DNA
ccctcctgtctgtgagggagat

SEQ ID NO: 41392 - DNA, 19 bp, synthetic construct
  misc_feature 1..19: note = Synthetic Construct
  source 1..19: mol_type = other DNA
agccacagccccatgacta

SEQ ID NO: 41393 - DNA, 20 bp, synthetic construct
  misc_feature 1..20: note = Synthetic Construct
  source 1..20: mol_type = other DNA
cgcacgtctcaggttgtgaa

SEQ ID NO: 41394 - DNA, 24 bp, synthetic construct
  misc_feature 1..24: note = Synthetic Construct
  source 1..24: mol_type = other DNA
gtcagtcccctctccctacaaatg

SEQ ID NO: 41395 - DNA, 21 bp, synthetic construct
  misc_feature 1..21: note = Synthetic Construct
  source 1..21: mol_type = other DNA
cgccccacaacccggatatta

SEQ ID NO: 41396 - DNA, 27 bp, synthetic construct
  misc_feature 1..27: note = Synthetic Construct
  source 1..27: mol_type = other DNA
gggtttgtgtgcatggaaagagaaatc

SEQ ID NO: 41397 - DNA, 21 bp, synthetic construct
  misc_feature 1..21: note = Synthetic Construct
  source 1..21: mol_type = other DNA
gcagcatttcctggcagtgta

SEQ ID NO: 41398 - DNA, 20 bp, synthetic construct
  misc_feature 1..20: note = Synthetic Construct
  source 1..20: mol_type = other DNA
agcaaggggagtgtgactga

SEQ ID NO: 41399 - DNA, 26 bp, synthetic construct
  misc_feature 1..26: note = Synthetic Construct
  source 1..26: mol_type = other DNA
cagaaccaaatccatagcccaaaatg

SEQ ID NO: 41400 - DNA, 23 bp, synthetic construct
  misc_feature 1..23: note = Synthetic Construct
  source 1..23: mol_type = other DNA
ctgatgcctcccctaaatgttct

SEQ ID NO: 41401 - DNA, 24 bp, synthetic construct
  misc_feature 1..24: note = Synthetic Construct
  source 1..24: mol_type = other DNA
ggtactaaggggtaatgccgagta

SEQ ID NO: 41402 - DNA, 22 bp, synthetic construct
  misc_feature 1..22: note = Synthetic Construct
  source 1..22: mol_type = other DNA
cctcacaccagagctgtccttt

SEQ ID NO: 41403 - DNA, 21 bp, synthetic construct
  misc_feature 1..21: note = Synthetic Construct
  source 1..21: mol_type = other DNA
tcgggtcctgcctttctcttg

SEQ ID NO: 41404 - DNA, 21 bp, synthetic construct
  misc_feature 1..21: note = Synthetic Construct
  source 1..21: mol_type = other DNA
gcaaacatcagctcccagtca

SEQ ID NO: 41405 - DNA, 24 bp, synthetic construct
  misc_feature 1..24: note = Synthetic Construct
  source 1..24: mol_type = other DNA
gcatctctggttcttcccaagtca

SEQ ID NO: 41406 - DNA, 22 bp, synthetic construct
  misc_feature 1..22: note = Synthetic Construct
  source 1..22: mol_type = other DNA
gacgctgatgtaacctggaagt

SEQ ID NO: 41407 - DNA, 26 bp, synthetic construct
  misc_feature 1..26: note = Synthetic Construct
  source 1..26: mol_type = other DNA
tggtgtcattctaatctctggaggta

SEQ ID NO: 41408 - DNA, 25 bp, synthetic construct
  misc_feature 1..25: note = Synthetic Construct
  source 1..25: mol_type = other DNA
caagggtatccccaagagatgttag

SEQ ID NO: 41409 - DNA, 23 bp, synthetic construct
  misc_feature 1..23: note = Synthetic Construct
  source 1..23: mol_type = other DNA
gacttactagcggacaggtttca

SEQ ID NO: 41410 - DNA, 24 bp, synthetic construct
  misc_feature 1..24: note = Synthetic Construct
  source 1..24: mol_type = other DNA
gctgtagacatgctcttggtgtct

SEQ ID NO: 41411 - DNA, 20 bp, synthetic construct
  misc_feature 1..20: note = Synthetic Construct
  source 1..20: mol_type = other DNA
ggccagcgatccagagagat

SEQ ID NO: 41412 - DNA, 27 bp, synthetic construct
  misc_feature 1..27: note = Synthetic Construct
  source 1..27: mol_type = other DNA
ctcaacagtgaagctgtgtatcctaag

SEQ ID NO: 41413 - DNA, 22 bp, synthetic construct
  misc_feature 1..22: note = Synthetic Construct
  source 1..22: mol_type = other DNA
aatcccaggaggccctgaaatc

SEQ ID NO: 41414 - DNA, 22 bp, synthetic construct
  misc_feature 1..22: note = Synthetic Construct
  source 1..22: mol_type = other DNA
ggctaaagcgacaggagcagat

SEQ ID NO: 41415 - DNA, 23 bp, synthetic construct
  misc_feature 1..23: note = Synthetic Construct
  source 1..23: mol_type = other DNA
ctcaaatcctcctgtctgtggaa

SEQ ID NO: 41416 - DNA, 25 bp, synthetic construct
  misc_feature 1..25: note = Synthetic Construct
  source 1..25: mol_type = other DNA
ggaaatacagggcctatggtagcaa

SEQ ID NO: 41417 - DNA, 20 bp, synthetic construct
  misc_feature 1..20: note = Synthetic Construct
  source 1..20: mol_type = other DNA
cgagctctccggcgatgtaa

SEQ ID NO: 41418 - DNA, 24 bp, synthetic construct
  misc_feature 1..24: note = Synthetic Construct
  source 1..24: mol_type = other DNA
gaggagggactatgaaggatgcta

SEQ ID NO: 41419 - DNA, 23 bp, synthetic construct
  misc_feature 1..23: note = Synthetic Construct
  source 1..23: mol_type = other DNA
ctggaattacatgccaccacact

SEQ ID NO: 41420 - DNA, 27 bp, synthetic construct
  misc_feature 1..27: note = Synthetic Construct
  source 1..27: mol_type = other DNA
ggctgcagaagttcatagcgttaaatc

SEQ ID NO: 41421 - DNA, 19 bp, synthetic construct
  misc_feature 1..19: note = Synthetic Construct
  source 1..19: mol_type = other DNA
tttcgggtccaggcgaact

SEQ ID NO: 41422 - DNA, 21 bp, synthetic construct
  misc_feature 1..21: note = Synthetic Construct
  source 1..21: mol_type = other DNA
ggagccagttggcatcacctt

SEQ ID NO: 41423 - DNA, 23 bp, synthetic construct
  misc_feature 1..23: note = Synthetic Construct
  source 1..23: mol_type = other DNA
actaggaaggtaagcaggaggaa

SEQ ID NO: 41424 - DNA, 22 bp, synthetic construct
  misc_feature 1..22: note = Synthetic Construct
  source 1..22: mol_type = other DNA
gctctctctgtacctgccaatc

SEQ ID NO: 41425 - DNA, 23 bp, synthetic construct
  misc_feature 1..23: note = Synthetic Construct
  source 1..23: mol_type = other DNA
aatacgtaggctttgcaggtcat

SEQ ID NO: 41426 - DNA, 22 bp, synthetic construct
  misc_feature 1..22: note = Synthetic Construct
  source 1..22: mol_type = other DNA
gcttgtcagtgatgggttgttg

SEQ ID NO: 41427 - DNA, 24 bp, synthetic construct
  misc_feature 1..24: note = Synthetic Construct
  source 1..24: mol_type = other DNA
gatgttgttttgcaggggtaagaa

SEQ ID NO: 41428 - DNA, 23 bp, synthetic construct
  misc_feature 1..23: note = Synthetic Construct
  source 1..23: mol_type = other DNA
actttagtggctcacaacggaaa

SEQ ID NO: 41429 - DNA, 24 bp, synthetic construct
  misc_feature 1..24: note = Synthetic Construct
  source 1..24: mol_type = other DNA
acagacagggataagtcagcaaga

SEQ ID NO: 41430 - DNA, 22 bp, synthetic construct
  misc_feature 1..22: note = Synthetic Construct
  source 1..22: mol_type = other DNA
gcagcagggcattaggacaaag

SEQ ID NO: 41431 - DNA, 26 bp, synthetic construct
  misc_feature 1..26: note = Synthetic Construct
  source 1..26: mol_type = other DNA
gctaccaggttaatccctccctgtag

SEQ ID NO: 41432 - DNA, 23 bp, synthetic construct
  misc_feature 1..23: note = Synthetic Construct
  source 1..23: mol_type = other DNA
gcatatcatgctggcttttggtt

SEQ ID NO: 41433 - DNA, 23 bp, synthetic construct
  misc_feature 1..23: note = Synthetic Construct
  source 1..23: mol_type = other DNA
ggatcaatctgggaaggctgtga

SEQ ID NO: 41434 - DNA, 22 bp, synthetic construct
  misc_feature 1..22: note = Synthetic Construct
  source 1..22: mol_type = other DNA
gcaacagcaatggcctggtaag

SEQ ID NO: 41435 - DNA, 30 bp, synthetic construct
  misc_feature 1..30: note = Synthetic Construct
  source 1..30: mol_type = other DNA
cctgaaagtgaaaaacaggatggttgtatg

SEQ ID NO: 41436 - DNA, 21 bp, synthetic construct
  misc_feature 1..21: note = Synthetic Construct
  source 1..21: mol_type = other DNA
acagctgagcacagtttgtct

SEQ ID NO: 41437 - DNA, 21 bp, synthetic construct
  misc_feature 1..21: note = Synthetic Construct
  source 1..21: mol_type = other DNA
ttgtcagtccccacccacctt

SEQ ID NO: 41438 - DNA, 22 bp, synthetic construct
  misc_feature 1..22: note = Synthetic Construct
  source 1..22: mol_type = other DNA
accgagcaacagggcttacttg

SEQ ID NO: 41439 - DNA, 22 bp, synthetic construct
  misc_feature 1..22: note = Synthetic Construct
  source 1..22: mol_type = other DNA
tcactgcgatgagttggtttct

SEQ ID NO: 41440 - DNA, 23 bp, synthetic construct
  misc_feature 1..23: note = Synthetic Construct
  source 1..23: mol_type = other DNA
attctaggcagaaaagggcaagt

SEQ ID NO: 41441 - DNA, 23 bp, synthetic construct
  misc_feature 1..23: note = Synthetic Construct
  source 1..23: mol_type = other DNA
tcatgggatcttgcctagtggta

SEQ ID NO: 41442 - DNA, 26 bp, synthetic construct
  misc_feature 1..26: note = Synthetic Construct
  source 1..26: mol_type = other DNA
cgtcttgtgttctctctaccctctgt

SEQ ID NO: 41443 - DNA, 24 bp, synthetic construct
  misc_feature 1..24: note = Synthetic Construct
  source 1..24: mol_type = other DNA
ccatctctttcccacttgcccata

SEQ ID NO: 41444 - DNA, 25 bp, synthetic construct
  misc_feature 1..25: note = Synthetic Construct
  source 1..25: mol_type = other DNA
gaaatgggaaacgagtgacctctat

SEQ ID NO: 41445 - DNA, 21 bp, synthetic construct
  misc_feature 1..21: note = Synthetic Construct
  source 1..21: mol_type = other DNA
ctttggcctggtggtttgaga

SEQ ID NO: 41446 - DNA, 23 bp, synthetic construct
  misc_feature 1..23: note = Synthetic Construct
  source 1..23: mol_type = other DNA
ccccaaaatggtatgaccaggat

SEQ ID NO: 41447 - DNA, 25 bp, synthetic construct
  misc_feature 1..25: note = Synthetic Construct
  source 1..25: mol_type = other DNA
tgactccagttgtttgggagaatac

SEQ ID NO: 41448 - DNA, 20 bp, synthetic construct
  misc_feature 1..20: note = Synthetic Construct
  source 1..20: mol_type = other DNA
ctcagcccatggtgagcatt

SEQ ID NO: 41449 - DNA, 23 bp, synthetic construct
  misc_feature 1..23: note = Synthetic Construct
  source 1..23: mol_type = other DNA
caaggtcctacaagacccagttt

SEQ ID NO: 41450 - DNA, 20 bp, synthetic construct
  misc_feature 1..20: note = Synthetic Construct
  source 1..20: mol_type = other DNA
gggactttgggctggactca

SEQ ID NO: 41451 - DNA, 23 bp, synthetic construct
  misc_feature 1..23: note = Synthetic Construct
  source 1..23: mol_type = other DNA
gcccatctaggagctgatactct

SEQ ID NO: 41452 - DNA, 21 bp, synthetic construct
  misc_feature 1..21: note = Synthetic Construct
  source 1..21: mol_type = other DNA
ccaccccgcattagtgtccat

SEQ ID NO: 41453 - DNA, 20 bp, synthetic construct
  misc_feature 1..20: note = Synthetic Construct
  source 1..20: mol_type = other DNA
ttgcgctcagccaagtgaga

SEQ ID NO: 41454 - DNA, 25 bp, synthetic construct
  misc_feature 1..25: note = Synthetic Construct
  source 1..25: mol_type = other DNA
cctggtgttaggatacagaccaact

SEQ ID NO: 41455 - DNA, 22 bp, synthetic construct
  misc_feature 1..22: note = Synthetic Construct
  source 1..22: mol_type = other DNA
cagggtacgtgtagagcagact

SEQ ID NO: 41456 - DNA, 24 bp, synthetic construct
  misc_feature 1..24: note = Synthetic Construct
  source 1..24: mol_type = other DNA
gcggaatctgaaagaaggccagat

SEQ ID NO: 41457 - DNA, 22 bp, synthetic construct
  misc_feature 1..22: note = Synthetic Construct
  source 1..22: mol_type = other DNA
ccagaccgcagccaagattcta

SEQ ID NO: 41458 - DNA, 24 bp, synthetic construct
  misc_feature 1..24: note = Synthetic Construct
  source 1..24: mol_type = other DNA
cattggtgcaatgctgtggtatag

SEQ ID NO: 41459 - DNA, 21 bp, synthetic construct
  misc_feature 1..21: note = Synthetic Construct
  source 1..21: mol_type = other DNA
tctcggtgtcctcctgtttca

SEQ ID NO: 41460 - DNA, 20 bp, synthetic construct
  misc_feature 1..20: note = Synthetic Construct
  source 1..20: mol_type = other DNA
gtgttcatggacgggtgtca

SEQ ID NO: 41461 - DNA, 20 bp, synthetic construct
  misc_feature 1..20: note = Synthetic Construct
  source 1..20: mol_type = other DNA
aggggatccctggggagcta

SEQ ID NO: 41462 - DNA, 24 bp, synthetic construct
  misc_feature 1..24: note = Synthetic Construct
  source 1..24: mol_type = other DNA
ctcccttacacagaaccccaattt

SEQ ID NO: 41463 - DNA, 26 bp, synthetic construct
  misc_feature 1..26: note = Synthetic Construct
  source 1..26: mol_type = other DNA
gccccttaattgaatgaccccatact

SEQ ID NO: 41464 - DNA, 26 bp, synthetic construct
  misc_feature 1..26: note = Synthetic Construct
  source 1..26: mol_type = other DNA
ggaaggaaaaatgcccagtcttctga

SEQ ID NO: 41465 - DNA, 26 bp, synthetic construct
  misc_feature 1..26: note = Synthetic Construct
  source 1..26: mol_type = other DNA
gggtctatcacgtgttacttgggaat

SEQ ID NO: 41466 - DNA, 23 bp, synthetic construct
  misc_feature 1..23: note = Synthetic Construct
  source 1..23: mol_type = other DNA
cctgcctcctaacggccaaatag

SEQ ID NO: 41467 - DNA, 21 bp, synthetic construct
  misc_feature 1..21: note = Synthetic Construct
  source 1..21: mol_type = other DNA
gatgctgaggattggccttct

SEQ ID NO: 41468 - DNA, 25 bp, synthetic construct
  misc_feature 1..25: note = Synthetic Construct
  source 1..25: mol_type = other DNA
ggcactggtgtagtgtttgagaaga

SEQ ID NO: 41469 - DNA, 23 bp, synthetic construct
  misc_feature 1..23: note = Synthetic Construct
  source 1..23: mol_type = other DNA
gcaactctttccacacccagcaa

SEQ ID NO: 41470 - DNA, 20 bp, synthetic construct
  misc_feature 1..20: note = Synthetic Construct
  source 1..20: mol_type = other DNA
aagtcggaggggccttcaca

SEQ ID NO: 41471 - DNA, 20 bp, synthetic construct
  misc_feature 1..20: note = Synthetic Construct
  source 1..20: mol_type = other DNA
tgtgtggaggtgggtacaga

SEQ ID NO: 41472 - DNA, 22 bp, synthetic construct
  misc_feature 1..22: note = Synthetic Construct
  source 1..22: mol_type = other DNA
gaccttcccttgtctgttggtt

SEQ ID NO: 41473 - DNA, 22 bp, synthetic construct
  misc_feature 1..22: note = Synthetic Construct
  source 1..22: mol_type = other DNA
gagggtggaaggctccaataac

SEQ ID NO: 41474 - DNA, 21 bp, synthetic construct
  misc_feature 1..21: note = Synthetic Construct
  source 1..21: mol_type = other DNA
aacctccatctgctcctgaga

SEQ ID NO: 41475 - DNA, 24 bp, synthetic construct
  misc_feature 1..24: note = Synthetic Construct
  source 1..24: mol_type = other DNA
tcccagaagtactcatcaccattg

SEQ ID NO: 41476 - DNA, 19 bp, synthetic construct
  misc_feature 1..19: note = Synthetic Construct
  source 1..19: mol_type = other DNA
tgaaggcagggcctgtttg

SEQ ID NO: 41477 - DNA, 22 bp, synthetic construct
  misc_feature 1..22: note = Synthetic Construct
  source 1..22: mol_type = other DNA
gcctgtttccaccacactctct

SEQ ID NO: 41478 - DNA, 21 bp, synthetic construct
  misc_feature 1..21: note = Synthetic Construct
  source 1..21: mol_type = other DNA
agcctcttcccttcactctgt

SEQ ID NO: 41479 - DNA, 22 bp, synthetic construct
  misc_feature 1..22: note = Synthetic Construct
  source 1..22: mol_type = other DNA
aatggaccagccctgtcagtag

SEQ ID NO: 41480 - DNA, 20 bp, synthetic construct
  misc_feature 1..20: note = Synthetic Construct
  source 1..20: mol_type = other DNA
cgcaacacagggagcgattt

SEQ ID NO: 41481 - DNA, 21 bp, synthetic construct
  misc_feature 1..21: note = Synthetic Construct
  source 1..21: mol_type = other DNA
tcctgaccctacaccaacact

SEQ ID NO: 41482 - DNA, 20 bp, synthetic construct
  misc_feature 1..20: note = Synthetic Construct
  source 1..20: mol_type = other DNA
acctggtgcccagcccatct

SEQ ID NO: 41483 - DNA, 21 bp, synthetic construct
  misc_feature 1..21: note = Synthetic Construct
  source 1..21: mol_type = other DNA
tgacatgcttgctgactgcat

SEQ ID NO: 41484 - DNA, 22 bp, synthetic construct
  misc_feature 1..22: note = Synthetic Construct
  source 1..22: mol_type = other DNA
agcccactctctgggtatgatg

SEQ ID NO: 41485 - DNA, 25 bp, synthetic construct
  misc_feature 1..25: note = Synthetic Construct
  source 1..25: mol_type = other DNA
gaggcaattgatggcataacgaaac

SEQ ID NO: 41486 - DNA, 24 bp, synthetic construct
  misc_feature 1..24: note = Synthetic Construct
  source 1..24: mol_type = other DNA
gtgccttaagtcccagtgatctgt

SEQ ID NO: 41487 - DNA, 24 bp, synthetic construct
  misc_feature 1..24: note = Synthetic Construct
  source 1..24: mol_type = other DNA
gcttcctcaacctgatgtttcaag

SEQ ID NO: 41488 - DNA, 21 bp, synthetic construct
  misc_feature 1..21: note = Synthetic Construct
  source 1..21: mol_type = other DNA
ggggatgagttctggcagtct

SEQ ID NO: 41489 - DNA, 22 bp, synthetic construct
  misc_feature 1..22: note = Synthetic Construct
  source 1..22: mol_type = other DNA
agggtgtggagcctgttactct

SEQ ID NO: 41490 - DNA, 20 bp, synthetic construct
  misc_feature 1..20: note = Synthetic Construct
  source 1..20: mol_type = other DNA
actccactcacccaggcttt

SEQ ID NO: 41491 - DNA, 24 bp, synthetic construct
  misc_feature 1..24: note = Synthetic Construct
  source 1..24: mol_type = other DNA
ctttgcattcgtgccacaatagtt

SEQ ID NO: 41492 - DNA, 22 bp, synthetic construct
  misc_feature 1..22: note = Synthetic Construct
  source 1..22: mol_type = other DNA
acacttgccgtcttcctgttac

SEQ ID NO: 41493 - DNA, 23 bp, synthetic construct
  misc_feature 1..23: note = Synthetic Construct
  source 1..23: mol_type = other DNA
caagacctaaggcatgcaagtca

SEQ ID NO: 41494 - DNA, 26 bp, synthetic construct
  misc_feature 1..26: note = Synthetic Construct
  source 1..26: mol_type = other DNA
cccttacaactccatcaagtaagaga

SEQ ID NO: 41495 - DNA, 20 bp, synthetic construct
  misc_feature 1..20: note = Synthetic Construct
  source 1..20: mol_type = other DNA
cagtcggaaggcgagagaga

SEQ ID NO: 41496 - DNA, 27 bp, synthetic construct
  misc_feature 1..27: note = Synthetic Construct
  source 1..27: mol_type = other DNA
cggttgatcccatggaattcagtctgt

SEQ ID NO: 41497 - DNA, 23 bp, synthetic construct
  misc_feature 1..23: note = Synthetic Construct
  source 1..23: mol_type = other DNA
ccacatccttgcacgtccaaatc

SEQ ID NO: 41498 - DNA, 22 bp, synthetic construct
  misc_feature 1..22: note = Synthetic Construct
  source 1..22: mol_type = other DNA
ccaactttgctccacactgcat

SEQ ID NO: 41499 - DNA, 22 bp, synthetic construct
  misc_feature 1..22: note = Synthetic Construct
  source 1..22: mol_type = other DNA
ggagagacacctgactccctaa

SEQ ID NO: 41500 - DNA, 20 bp, synthetic construct
  misc_feature 1..20: note = Synthetic Construct
  source 1..20: mol_type = other DNA
atccacttggccctccagaa

SEQ ID NO: 41501 - DNA, 23 bp, synthetic construct
  misc_feature 1..23: note = Synthetic Construct
  source 1..23: mol_type = other DNA
gccatgtcccgtaccacttctac

SEQ ID NO: 41502 - DNA, 25 bp, synthetic construct
  misc_feature 1..25: note = Synthetic Construct
  source 1..25: mol_type = other DNA
aatgaactaggagaagagggctaga

SEQ ID NO: 41503 - DNA, 18 bp, synthetic construct
  misc_feature 1..18: note = Synthetic Construct
  source 1..18: mol_type = other DNA
gcgtaggccaccaacagt

SEQ ID NO: 41504 - DNA, 21 bp, synthetic construct
  misc_feature 1..21: note = Synthetic Construct
  source 1..21: mol_type = other DNA
tggtgtttcttcccacacgtt

SEQ ID NO: 41505 - DNA, 20 bp, synthetic construct
  misc_feature 1..20: note = Synthetic Construct
  source 1..20: mol_type = other DNA
ggcacatctggggcaaaaca

SEQ ID NO: 41506 - DNA, 20 bp, synthetic construct
  misc_feature 1..20: note = Synthetic Construct
  source 1..20: mol_type = other DNA
caagcctgtgctgctagact

SEQ ID NO: 41507 - DNA, 26 bp, synthetic construct
  misc_feature 1..26: note = Synthetic Construct
  source 1..26: mol_type = other DNA
gcatctccttaccctatacggcttca

SEQ ID NO: 41508 - DNA, 23 bp, synthetic construct
  misc_feature 1..23: note = Synthetic Construct
  source 1..23: mol_type = other DNA
acccaattggcagttctcaactt

SEQ ID NO: 41509 - DNA, 20 bp, synthetic construct
  misc_feature 1..20: note = Synthetic Construct
  source 1..20: mol_type = other DNA
cctggcatgaaaggggctaa

SEQ ID NO: 41510 - DNA, 19 bp, synthetic construct
  misc_feature 1..19: note = Synthetic Construct
  source 1..19: mol_type = other DNA
agtgctgcagatgggcatt

SEQ ID NO: 41511 - DNA, 20 bp, synthetic construct
  misc_feature 1..20: note = Synthetic Construct
  source 1..20: mol_type = other DNA
tacctccacagaggcagctt

SEQ ID NO: 41512 - DNA, 22 bp, synthetic construct
  misc_feature 1..22: note = Synthetic Construct
  source 1..22: mol_type = other DNA
tttgctggcatactgggtttct

SEQ ID NO: 41513 - DNA, 22 bp, synthetic construct
  misc_feature 1..22: note = Synthetic Construct
  source 1..22: mol_type = other DNA
gtcggtgggtttagggacagaa

SEQ ID NO: 41514 - DNA, 20 bp, synthetic construct
  misc_feature 1..20: note = Synthetic Construct
  source 1..20: mol_type = other DNA
gctggagggaggctaagtga

SEQ ID NO: 41515 - DNA, 24 bp, synthetic construct
  misc_feature 1..24: note = Synthetic Construct
  source 1..24: mol_type = other DNA
ccacttctgtaccgtctccaccaa

SEQ ID NO: 41516 - DNA, 23 bp, synthetic construct
  misc_feature 1..23: note = Synthetic Construct
  source 1..23: mol_type = other DNA
ccctcaaaactagggtgaccaaa

SEQ ID NO: 41517 - DNA, 23 bp, synthetic construct
  misc_feature 1..23: note = Synthetic Construct
  source 1..23: mol_type = other DNA
cccactagactccaagaggtttc

SEQ ID NO: 41518 - DNA, 22 bp, synthetic construct
  misc_feature 1..22: note = Synthetic Construct
  source 1..22: mol_type = other DNA
ccattcgtagtcctgcctggat

SEQ ID NO: 41519 - DNA, 21 bp, synthetic construct
  misc_feature 1..21: note = Synthetic Construct
  source 1..21: mol_type = other DNA
acctactgatggtgggcttca

SEQ ID NO: 41520 - DNA, 25 bp, synthetic construct
  misc_feature 1..25: note = Synthetic Construct
  source 1..25: mol_type = other DNA
acaaaggaccacataagggagtatg

SEQ ID NO: 41521 - DNA, 20 bp, synthetic construct
  misc_feature 1..20: note = Synthetic Construct
  source 1..20: mol_type = other DNA
ggcagcaggtctctgcaaaa

SEQ ID NO: 41522 - DNA, 21 bp, synthetic construct
  misc_feature 1..21: note = Synthetic Construct
  source 1..21: mol_type = other DNA
ccccacaccccttgcattctt

SEQ ID NO: 41523 - DNA, 27 bp, synthetic construct
  misc_feature 1..27: note = Synthetic Construct
  source 1..27: mol_type = other DNA
ggacacagataagttgccattctcgta

SEQ ID NO: 41524 - DNA, 20 bp, synthetic construct
  misc_feature 1..20: note = Synthetic Construct
  source 1..20: mol_type = other DNA
tcagcagagtctggcactca

SEQ ID NO: 41525 - DNA, 20 bp, synthetic construct
  misc_feature 1..20: note = Synthetic Construct
  source 1..20: mol_type = other DNA
aggctctgggctgggagaag

SEQ ID NO: 41526 - DNA, 23 bp, synthetic construct
  misc_feature 1..23: note = Synthetic Construct
  source 1..23: mol_type = other DNA
gtggaagacacatggcctaatca

SEQ ID NO: 41527 - DNA, 20 bp, synthetic construct
  misc_feature 1..20: note = Synthetic Construct
  source 1..20: mol_type = other DNA
tgacagaggccagtcactca

SEQ ID NO: 41528 - DNA, 25 bp, synthetic construct
  misc_feature 1..25: note = Synthetic Construct
  source 1..25: mol_type = other DNA
ctctttgttgagaaacaggggaagt

SEQ ID NO: 41529 - DNA, 22 bp, synthetic construct
  misc_feature 1..22: note = Synthetic Construct
  source 1..22: mol_type = other DNA
accaacaggtgaaaggtgactt

SEQ ID NO: 41530 - DNA, 23 bp, synthetic construct
  misc_feature 1..23: note = Synthetic Construct
  source 1..23: mol_type = other DNA
catgctaagggcaacagcatttc

SEQ ID NO: 41531 - DNA, 20 bp, synthetic construct
  misc_feature 1..20: note = Synthetic Construct
  source 1..20: mol_type = other DNA
aggagccacgaagcctgtga

SEQ ID NO: 41532 - DNA, 20 bp, synthetic construct
  misc_feature 1..20: note = Synthetic Construct
  source 1..20: mol_type = other DNA
aggaggggtggctgccatga

SEQ ID NO: 41533 - DNA, 20 bp, synthetic construct
  misc_feature 1..20: note = Synthetic Construct
  source 1..20: mol_type = other DNA
ttcggtgaaggacgcgcaaa

SEQ ID NO: 41534 - DNA, 27 bp, synthetic construct
  misc_feature 1..27: note = Synthetic Construct
  source 1..27: mol_type = other DNA
cagaagataagttaaacggcagccaaa

SEQ ID NO: 41535 - DNA, 24 bp, synthetic construct
  misc_feature 1..24: note = Synthetic Construct
  source 1..24: mol_type = other DNA
ggaaaggacacaattgccagaaga

SEQ ID NO: 41536 - DNA, 22 bp, synthetic construct
  misc_feature 1..22: note = Synthetic Construct
  source 1..22: mol_type = other DNA
aggaggtcctgttgagctggta

SEQ ID NO: 41537 - DNA, 22 bp, synthetic construct
  misc_feature 1..22: note = Synthetic Construct
  source 1..22: mol_type = other DNA
gtcccctcacaattgccctgaa

SEQ ID NO: 41538 - DNA, 22 bp, synthetic construct
  misc_feature 1..22: note = Synthetic Construct
  source 1..22: mol_type = other DNA
cacactcaagacccgctgattc

SEQ ID NO: 41539 - DNA, 27 bp, synthetic construct
  misc_feature 1..27: note = Synthetic Construct
  source 1..27: mol_type = other DNA
ccgttaaaatggccttatgcgtgtttg

SEQ ID NO: 41540 - DNA, 21 bp, synthetic construct
  misc_feature 1..21: note = Synthetic Construct
  source 1..21: mol_type = other DNA
tctgtggccctaacacctaca

SEQ ID NO: 41541 - DNA, 25 bp, synthetic construct
  misc_feature 1..25: note = Synthetic Construct
  source 1..25: mol_type = other DNA
tctactctcctgtggtttagcttct

SEQ ID NO: 41542 - DNA, 24 bp, synthetic construct
  misc_feature 1..24: note = Synthetic Construct
  source 1..24: mol_type = other DNA
ggactggaagcaaaccagaaacta

SEQ ID NO: 41543 - DNA, 22 bp, synthetic construct
  misc_feature 1..22: note = Synthetic Construct
  source 1..22: mol_type = other DNA
tgccaagtcattgctcttctgt

SEQ ID NO: 41544 - DNA, 20 bp, synthetic construct
  misc_feature 1..20: note = Synthetic Construct
  source 1..20: mol_type = other DNA
tcaaagcctggccaccatca

SEQ ID NO: 41545 - DNA, 22 bp, synthetic construct
  misc_feature 1..22: note = Synthetic Construct
  source 1..22: mol_type = other DNA
gtcccgtccctaaaaccatctt

SEQ ID NO: 41546 - DNA, 21 bp, synthetic construct
  misc_feature 1..21: note = Synthetic Construct
  source 1..21: mol_type = other DNA
tgcccaacgatccctctgcat

SEQ ID NO: 41547 - DNA, 21 bp, synthetic construct
  misc_feature 1..21: note = Synthetic Construct
  source 1..21: mol_type = other DNA
gaaggcagccaacagtgtagt

SEQ ID NO: 41548 - DNA, 20 bp, synthetic construct
  misc_feature 1..20: note = Synthetic Construct
  source 1..20: mol_type = other DNA
cggttgcactttccctcctt

SEQ ID NO: 41549 - DNA, 19 bp, synthetic construct
  misc_feature 1..19: note = Synthetic Construct
  source 1..19: mol_type = other DNA
accctcccttccccagact

SEQ ID NO: 41550 - DNA, 21 bp, synthetic construct
  misc_feature 1..21: note = Synthetic Construct
  source 1..21: mol_type = other DNA
ccagcctctcagtcctgaaca

SEQ ID NO: 41551 - DNA, 20 bp, synthetic construct
  misc_feature 1..20: note = Synthetic Construct
  source 1..20: mol_type = other DNA
gcttgtgaccaccacactga

SEQ ID NO: 41552 - DNA, 26 bp, synthetic construct
  misc_feature 1..26: note = Synthetic Construct
  source 1..26: mol_type = other DNA
gcccatggagttacctaatggaccta

SEQ ID NO: 41553 - DNA, 21 bp, synthetic construct
  misc_feature 1..21: note = Synthetic Construct
  source 1..21: mol_type = other DNA
gagcgggtcacttcacctttt

SEQ ID NO: 41554 - DNA, 22 bp, synthetic construct
  misc_feature 1..22: note = Synthetic Construct
  source 1..22: mol_type = other DNA
cagcttcctgcccagtgataag

SEQ ID NO: 41555 - DNA, 23 bp, synthetic construct
  misc_feature 1..23: note = Synthetic Construct
  source 1..23: mol_type = other DNA
gctcagtagctggggcttgtatg

SEQ ID NO: 41556 - DNA, 24 bp, synthetic construct
  misc_feature 1..24: note = Synthetic Construct
  source 1..24: mol_type = other DNA
cagctagatttgtctccagctcaa

SEQ ID NO: 41557 - DNA, 21 bp, synthetic construct
  misc_feature 1..21: note = Synthetic Construct
  source 1..21: mol_type = other DNA
gcctcctgttgggtcagagaa

SEQ ID NO: 41558 - DNA, 24 bp, synthetic construct
  misc_feature 1..24: note = Synthetic Construct
  source 1..24: mol_type = other DNA
caaaagaaacactctgggctccaa

SEQ ID NO: 41559 - DNA, 23 bp, synthetic construct
  misc_feature 1..23: note = Synthetic Construct
  source 1..23: mol_type = other DNA
ctgctgctttacccattctcagt

SEQ ID NO: 41560 - DNA, 25 bp, synthetic construct
  misc_feature 1..25: note = Synthetic Construct
  source 1..25: mol_type = other DNA
cctgtctttttaaccctttgcatca

SEQ ID NO: 41561 - DNA, 23 bp, synthetic construct
  misc_feature 1..23: note = Synthetic Construct
  source 1..23: mol_type = other DNA
ctgagatggtcactgtccctcaa

SEQ ID NO: 41562 - DNA, 26 bp, synthetic construct
  misc_feature 1..26: note = Synthetic Construct
  source 1..26: mol_type = other DNA
gcctcacttccctttttctttcattc

SEQ ID NO: 41563 - DNA, 23 bp, synthetic construct
  misc_feature 1..23: note = Synthetic Construct
  source 1..23: mol_type = other DNA
ggaacgatgtcacctctctggtt

SEQ ID NO: 41564 - DNA, 25 bp, synthetic construct
  misc_feature 1..25: note = Synthetic Construct
  source 1..25: mol_type = other DNA
ttccttaaattggctggttgtcttg

SEQ ID NO: 41565 - DNA, 24 bp, synthetic construct
  misc_feature 1..24: note = Synthetic Construct
  source 1..24: mol_type = other DNA
ttcattcaatcaggcccttgagaa

SEQ ID NO: 41566 - DNA, 21 bp, synthetic construct
  misc_feature 1..21: note = Synthetic Construct
  source 1..21: mol_type = other DNA
cagccaatgggcatcagtttc

SEQ ID NO: 41567 - DNA, 21 bp, synthetic construct
  misc_feature 1..21: note = Synthetic Construct
  source 1..21: mol_type = other DNA
cagaactgccctgtggaaaga

SEQ ID NO: 41568 - DNA, 20 bp, synthetic construct
  misc_feature 1..20: note = Synthetic Construct
  source 1..20: mol_type = other DNA
tcctaccgcaccacactttc

SEQ ID NO: 41569 - DNA, 22 bp, synthetic construct
  misc_feature 1..22: note = Synthetic Construct
  source 1..22: mol_type = other DNA
caggtctcaccccacaactact

SEQ ID NO: 41570 - DNA, 27 bp, synthetic construct
  misc_feature 1..27: note = Synthetic Construct
  source 1..27: mol_type = other DNA
gcagaggattctaagccttgacaaact

SEQ ID NO: 41571 - DNA, 21 bp, synthetic construct
  misc_feature 1..21: note = Synthetic Construct
  source 1..21: mol_type = other DNA
tctggaggggcagtagcatca

SEQ ID NO: 41572 - DNA, 24 bp, synthetic construct
  misc_feature 1..24: note = Synthetic Construct
  source 1..24: mol_type = other DNA
cgtagcagatgcttagtggtcatc

SEQ ID NO: 41573 - DNA, 24 bp, synthetic construct
  misc_feature 1..24: note = Synthetic Construct
  source 1..24: mol_type = other DNA
cacatggtcaagtccaaagtcaga

SEQ ID NO: 41574 - DNA, 23 bp, synthetic construct
  misc_feature 1..23: note = Synthetic Construct
  source 1..23: mol_type = other DNA
cactgtgggctacacagaaccta

SEQ ID NO: 41575 - DNA, 22 bp, synthetic construct
  misc_feature 1..22: note = Synthetic Construct
  source 1..22: mol_type = other DNA
gctagctatggggtgaggtcaa

SEQ ID NO: 41576 - DNA, 30 bp, synthetic construct
  misc_feature 1..30: note = Synthetic Construct
  source 1..30: mol_type = other DNA
cccacttaactgagtatcggtagatctgaa

SEQ ID NO: 41577 - DNA, 25 bp, synthetic construct
  misc_feature 1..25: note = Synthetic Construct
  source 1..25: mol_type = other DNA
gtgatggggcagagttaatccttgt

SEQ ID NO: 41578 - DNA, 26 bp, synthetic construct
  misc_feature 1..26: note = Synthetic Construct
  source 1..26: mol_type = other DNA
gcttgccaaaggtcataatggagact

SEQ ID NO: 41579 - DNA, 19 bp, synthetic construct
  misc_feature 1..19: note = Synthetic Construct
  source 1..19: mol_type = other DNA
gccaactggcagcatctga

SEQ ID NO: 41580 - DNA, 23 bp, synthetic construct
  misc_feature 1..23: note = Synthetic Construct
  source 1..23: mol_type = other DNA
ggcaaaaggaaacctgtcacgta

SEQ ID NO: 41581 - DNA, 22 bp, synthetic construct
  misc_feature 1..22: note = Synthetic Construct
  source 1..22: mol_type = other DNA
cgaacatggccgtgtgctttag

SEQ ID NO: 41582 - DNA, 24 bp, synthetic construct
  misc_feature 1..24: note = Synthetic Construct
  source 1..24: mol_type = other DNA
gaccttgcaagaagatgagctgaa

SEQ ID NO: 41583 - DNA, 23 bp, synthetic construct
  misc_feature 1..23: note = Synthetic Construct
  source 1..23: mol_type = other DNA
gacttgagatcagccgctcagat

SEQ ID NO: 41584 - DNA, 20 bp, synthetic construct
  misc_feature 1..20: note = Synthetic Construct
  source 1..20: mol_type = other DNA
agggaaaggctgtggctgta

SEQ ID NO: 41585 - DNA, 22 bp, synthetic construct
  misc_feature 1..22: note = Synthetic Construct
  source 1..22: mol_type = other DNA
ccacctagtaggcgttgacctt

SEQ ID NO: 41586 - DNA, 26 bp, synthetic construct
  misc_feature 1..26: note = Synthetic Construct
  source 1..26: mol_type = other DNA
ctccacttgtgtactaaatcccaact

SEQ ID NO: 41587 - DNA, 25 bp, synthetic construct
  misc_feature 1..25: note = Synthetic Construct
  source 1..25: mol_type = other DNA
cactctgtatggtagcgattctcaa

SEQ ID NO: 41588 - DNA, 22 bp, synthetic construct
  misc_feature 1..22: note = Synthetic Construct
  source 1..22: mol_type = other DNA
tggagtcacctgtgaggtcaac

SEQ ID NO: 41589 - DNA, 21 bp, synthetic construct
  misc_feature 1..21: note = Synthetic Construct
  source 1..21: mol_type = other DNA
gctcctttgttctcccaccaa

SEQ ID NO: 41590 - DNA, 20 bp, synthetic construct
  misc_feature 1..20: note = Synthetic Construct
  source 1..20: mol_type = other DNA
gtcagccacagcaagccaat

SEQ ID NO: 41591 - DNA, 22 bp, synthetic construct
  misc_feature 1..22: note = Synthetic Construct
  source 1..22: mol_type = other DNA
ccccattggtgccaagagcata

SEQ ID NO: 41592 - DNA, 23 bp, synthetic construct
  misc_feature 1..23: note = Synthetic Construct
  source 1..23: mol_type = other DNA
tgcttgggaattacagcagttca

SEQ ID NO: 41593 - DNA, 21 bp, synthetic construct
  misc_feature 1..21: note = Synthetic Construct
  source 1..21: mol_type = other DNA
ggttagggtgtcccagccata

SEQ ID NO: 41594 - DNA, 21 bp, synthetic construct
  misc_feature 1..21: note = Synthetic Construct
  source 1..21: mol_type = other DNA
gtcccagtttgtgagcaggtt

SEQ ID NO: 41595 - DNA, 26 bp, synthetic construct
  misc_feature 1..26: note = Synthetic Construct
  source 1..26: mol_type = other DNA
cccaaagcatttcattaccacctgaa

SEQ ID NO: 41596 - DNA, 24 bp, synthetic construct
  misc_feature 1..24: note = Synthetic Construct
  source 1..24: mol_type = other DNA
aaggtgttcagaggagaaatgtgt

SEQ ID NO: 41597 - DNA, 22 bp, synthetic construct
  misc_feature 1..22: note = Synthetic Construct
  source 1..22: mol_type = other DNA
cccatccttatgggctgtgaaa

SEQ ID NO: 41598 - DNA, 23 bp, synthetic construct
  misc_feature 1..23: note = Synthetic Construct
  source 1..23: mol_type = other DNA
tggatataggccttgacggttga

SEQ ID NO: 41599 - DNA, 26 bp, synthetic construct
  misc_feature 1..26: note = Synthetic Construct
  source 1..26: mol_type = other DNA
gagaacccttatttcttggtccacat

SEQ ID NO: 41600 - DNA, 22 bp, synthetic construct
  misc_feature 1..22: note = Synthetic Construct
  source 1..22: mol_type = other DNA
aaagagaggaagggccctgaac

SEQ ID NO: 41601 - DNA, 24 bp, synthetic construct
  misc_feature 1..24: note = Synthetic Construct
  source 1..24: mol_type = other DNA
atggagtgatctccctcatctaca

SEQ ID NO: 41602 - DNA, 22 bp, synthetic construct
  misc_feature 1..22: note = Synthetic Construct
  source 1..22: mol_type = other DNA
caggatggctctgggcatctta

SEQ ID NO: 41603 - DNA, 23 bp, synthetic construct
  misc_feature 1..23: note = Synthetic Construct
  source 1..23: mol_type = other DNA
cctcagatggggtgaggatgcta

SEQ ID NO: 41604 - DNA, 22 bp, synthetic construct
  misc_feature 1..22: note = Synthetic Construct
  source 1..22: mol_type = other DNA
ccatttggtcctggccacattc

SEQ ID NO: 41605 - DNA, 22 bp, synthetic construct
  misc_feature 1..22: note = Synthetic Construct
  source 1..22: mol_type = other DNA
ttctttgatccggggagagact

SEQ ID NO: 41606 - DNA, 27 bp, synthetic construct
  misc_feature 1..27: note = Synthetic Construct
  source 1..27: mol_type = other DNA
cctggataactatcggttggctaattg

SEQ ID NO: 41607 - DNA, 21 bp, synthetic construct
  misc_feature 1..21: note = Synthetic Construct
  source 1..21: mol_type = other DNA
gttcaggcatgtgacctgcta

SEQ ID NO: 41608 - DNA, 20 bp, synthetic construct
  misc_feature 1..20: note = Synthetic Construct
  source 1..20: mol_type = other DNA
ggtgggaaacgggtgcagat

SEQ ID NO: 41609 - DNA, 22 bp, synthetic construct
  misc_feature 1..22: note = Synthetic Construct
  source 1..22: mol_type = other DNA
ggtggagtctgtggttgtgaga

SEQ ID NO: 41610 - DNA, 20 bp, synthetic construct
  misc_feature 1..20: note = Synthetic Construct
  source 1..20: mol_type = other DNA
accaccctcgcagacctttg

SEQ ID NO: 41611 - DNA, 25 bp, synthetic construct
  misc_feature 1..25: note = Synthetic Construct
  source 1..25: mol_type = other DNA
tgaggtagggatccaaacttactct

SEQ ID NO: 41612 - DNA, 24 bp, synthetic construct
  misc_feature 1..24: note = Synthetic Construct
  source 1..24: mol_type = other DNA
gtggctggcaaaggatgatataga

SEQ ID NO: 41613 - DNA, 20 bp, synthetic construct
  misc_feature 1..20: note = Synthetic Construct
  source 1..20: mol_type = other DNA
gaggcagcaaagcctggaat

SEQ ID NO: 41614 - DNA, 23 bp, synthetic construct
  misc_feature 1..23: note = Synthetic Construct
  source 1..23: mol_type = other DNA
cagccattcaatcaccctgtttc

SEQ ID NO: 41615 - DNA, 20 bp, synthetic construct
  misc_feature 1..20: note = Synthetic Construct
  source 1..20: mol_type = other DNA
tggaatggtggtgccagttg

SEQ ID NO: 41616 - DNA, 21 bp, synthetic construct
  misc_feature 1..21: note = Synthetic Construct
  source 1..21: mol_type = other DNA
tccagtttctgaggccagagt

SEQ ID NO: 41617 - DNA, 23 bp, synthetic construct
  misc_feature 1..23: note = Synthetic Construct
  source 1..23: mol_type = other DNA
accttcacccaggggtatagaag

SEQ ID NO: 41618 - DNA, 26 bp, synthetic construct
  misc_feature 1..26: note = Synthetic Construct
  source 1..26: mol_type = other DNA
catctccggatctccattttcttact

SEQ ID NO: 41619 - DNA, 23 bp, synthetic construct
  misc_feature 1..23: note = Synthetic Construct
  source 1..23: mol_type = other DNA
ccacagtcccaaaagggctgtat

SEQ ID NO: 41620 - DNA, 23 bp, synthetic construct
  misc_feature 1..23: note = Synthetic Construct
  source 1..23: mol_type = other DNA
ccatcgtgtccttgcacccttag

SEQ ID NO: 41621 - DNA, 22 bp, synthetic construct
  misc_feature 1..22: note = Synthetic Construct
  source 1..22: mol_type = other DNA
cctgtgcactcaggccctatac

SEQ ID NO: 41622 - DNA, 22 bp, synthetic construct
  misc_feature 1..22: note = Synthetic Construct
  source 1..22: mol_type = other DNA
cacacacaagtggaggacatga

SEQ ID NO: 41623 - DNA, 25 bp, synthetic construct
  misc_feature 1..25: note = Synthetic Construct
  source 1..25: mol_type = other DNA
gaggcttaagggaaaagcctaacta

SEQ ID NO: 41624 - DNA, 25 bp, synthetic construct
  misc_feature 1..25: note = Synthetic Construct
  source 1..25: mol_type = other DNA
gatgttagtgactgtgactggatct

SEQ ID NO: 41625 - DNA, 22 bp, synthetic construct
  misc_feature 1..22: note = Synthetic Construct
  source 1..22: mol_type = other DNA
tcgaggttgagagcctgtgatg

SEQ ID NO: 41626 - DNA, 19 bp, synthetic construct
  misc_feature 1..19: note = Synthetic Construct
  source 1..19: mol_type = other DNA
tgtgggccatcagcagctt

SEQ ID NO: 41627 - DNA, 25 bp, synthetic construct
  misc_feature 1..25: note = Synthetic Construct
  source 1..25: mol_type = other DNA
ggttcaggaatctcctttgctcgaa

SEQ ID NO: 41628 - DNA, 24 bp, synthetic construct
  misc_feature 1..24: note = Synthetic Construct
  source 1..24: mol_type = other DNA
cacatgattccctgttgcagtttg

SEQ ID NO: 41629 - DNA, 19 bp, synthetic construct
  misc_feature 1..19: note = Synthetic Construct
  source 1..19: mol_type = other DNA
cctgtggcccagtgagtga

SEQ ID NO: 41630 - DNA, 18 bp, synthetic construct
  misc_feature 1..18: note = Synthetic Construct
  source 1..18: mol_type = other DNA
ttgcacggaggccacaca

SEQ ID NO: 41631 - DNA, 26 bp, synthetic construct
  misc_feature 1..26: note = Synthetic Construct
  source 1..26: mol_type = other DNA
ccatggactctattatcaacgcaaag

SEQ ID NO: 41632 - DNA, 23 bp, synthetic construct
  misc_feature 1..23: note = Synthetic Construct
  source 1..23: mol_type = other DNA
ggcttataggcaacccagtcaca

SEQ ID NO: 41633 - DNA, 22 bp, synthetic construct
  misc_feature 1..22: note = Synthetic Construct
  source 1..22: mol_type = other DNA
ggctggtccagtagttccagta

SEQ ID NO: 41634 - DNA, 22 bp, synthetic construct
  misc_feature 1..22: note = Synthetic Construct
  source 1..22: mol_type = other DNA
ggtcctgtggatgcagcgattt

SEQ ID NO: 41635 - DNA, 20 bp, synthetic construct
  misc_feature 1..20: note = Synthetic Construct
  source 1..20: mol_type = other DNA
agggcaaggcctcaacatga

SEQ ID NO: 41636 - DNA, 23 bp, synthetic construct
  misc_feature 1..23: note = Synthetic Construct
  source 1..23: mol_type = other DNA
gagtgcatatccagctgttctct

SEQ ID NO: 41637 - DNA, 22 bp, synthetic construct
  misc_feature 1..22: note = Synthetic Construct
  source 1..22: mol_type = other DNA
gtgggaactggatgggttggaa

SEQ ID NO: 41638 - DNA, 21 bp, synthetic construct
  misc_feature 1..21: note = Synthetic Construct
  source 1..21: mol_type = other DNA
ttccgtggtaccgggtgttca

SEQ ID NO: 41639 - DNA, 23 bp, synthetic construct
  misc_feature 1..23: note = Synthetic Construct
  source 1..23: mol_type = other DNA
aggtacttggctctgagagtctt

SEQ ID NO: 41640 - DNA, 26 bp, synthetic construct
  misc_feature 1..26: note = Synthetic Construct
  source 1..26: mol_type = other DNA
caccttcttcctaaatccctccaatg

SEQ ID NO: 41641 - DNA, 23 bp, synthetic construct
  misc_feature 1..23: note = Synthetic Construct
  source 1..23: mol_type = other DNA
ctgcccacataaagagagcatgt

SEQ ID NO: 41642 - DNA, 21 bp, synthetic construct
  misc_feature 1..21: note = Synthetic Construct
  source 1..21: mol_type = other DNA
aaccaggtgccagtgctgcta

SEQ ID NO: 41643 - DNA, 22 bp, synthetic construct
  misc_feature 1..22: note = Synthetic Construct
  source 1..22: mol_type = other DNA
agatgacttgccaaggaacaca

SEQ ID NO: 41644 - DNA, 23 bp, synthetic construct
  misc_feature 1..23: note = Synthetic Construct
  source 1..23: mol_type = other DNA
gcccatgaaattgcacctcattc

SEQ ID NO: 41645 - DNA, 22 bp, synthetic construct
  misc_feature 1..22: note = Synthetic Construct
  source 1..22: mol_type = other DNA
cgatgagcctctgcctactttc

SEQ ID NO: 41646 - DNA, 23 bp, synthetic construct
  misc_feature 1..23: note = Synthetic Construct
  source 1..23: mol_type = other DNA
caccacacaggtcctcataccta

SEQ ID NO: 41647 - DNA, 24 bp, synthetic construct
  misc_feature 1..24: note = Synthetic Construct
  source 1..24: mol_type = other DNA
gcagatgctcaggctctgtcaata

SEQ ID NO: 41648 - DNA, 19 bp, synthetic construct
  misc_feature 1..19: note = Synthetic Construct
  source 1..19: mol_type = other DNA
ccagggctgagtgctgcat

SEQ ID NO: 41649 - DNA, 22 bp, synthetic construct
  misc_feature 1..22: note = Synthetic Construct
  source 1..22: mol_type = other DNA
tgggatcagaaagcctgagttc

SEQ ID NO: 41650 - DNA, 22 bp, synthetic construct
  misc_feature 1..22: note = Synthetic Construct
  source 1..22: mol_type = other DNA
gcccttcccacctctccaaata

SEQ ID NO: 41651 - DNA, 22 bp, synthetic construct
  misc_feature 1..22: note = Synthetic Construct
  source 1..22: mol_type = other DNA
tccttgaggccatcctcttcat

SEQ ID NO: 41652 - DNA, 27 bp, synthetic construct
  misc_feature 1..27: note = Synthetic Construct
  source 1..27: mol_type = other DNA
gggaataatggacagagagtcctcgaa

SEQ ID NO: 41653 - DNA, 22 bp, synthetic construct
  misc_feature 1..22: note = Synthetic Construct
  source 1..22: mol_type = other DNA
cctgtggggagtagaagcaact

SEQ ID NO: 41654 - DNA, 23 bp, synthetic construct
  misc_feature 1..23: note = Synthetic Construct
  source 1..23: mol_type = other DNA
gattgggttctggccaatgagat

SEQ ID NO: 41655 - DNA, 22 bp, synthetic construct
  misc_feature 1..22: note = Synthetic Construct
  source 1..22: mol_type = other DNA
cggtgtcttggagagaggatga

SEQ ID NO: 41656 - DNA, 20 bp, synthetic construct
  misc_feature 1..20: note = Synthetic Construct
  source 1..20: mol_type = other DNA
aggtgcagccttcgatgaga

SEQ ID NO: 41657 - DNA, 25 bp, synthetic construct
  misc_feature 1..25: note = Synthetic Construct
  source 1..25: mol_type = other DNA
gaaacaggcatcataccaactctga

SEQ ID NO: 41658 - DNA, 20 bp, synthetic construct
  misc_feature 1..20: note = Synthetic Construct
  source 1..20: mol_type = other DNA
gccaggcgtgttgctaggta

SEQ ID NO: 41659 - DNA, 26 bp, synthetic construct
  misc_feature 1..26: note = Synthetic Construct
  source 1..26: mol_type = other DNA
gctgctaacaaaatcaggagcctttg

SEQ ID NO: 41660 - DNA, 24 bp, synthetic construct
  misc_feature 1..24: note = Synthetic Construct
  source 1..24: mol_type = other DNA
ggacatttggggatgtgagtgtta

SEQ ID NO: 41661 - DNA, 21 bp, synthetic construct
  misc_feature 1..21: note = Synthetic Construct
  source 1..21: mol_type = other DNA
atcctcccactctcgggtgaa

SEQ ID NO: 41662 - DNA, 21 bp, synthetic construct
  misc_feature 1..21: note = Synthetic Construct
  source 1..21: mol_type = other DNA
gcaaccctgtgtgttccttct

SEQ ID NO: 41663 - DNA, 24 bp, synthetic construct
  misc_feature 1..24: note = Synthetic Construct
  source 1..24: mol_type = other DNA
gtatctcccgtgaagagtcctact

SEQ ID NO: 41664 - DNA, 21 bp, synthetic construct
  misc_feature 1..21: note = Synthetic Construct
  source 1..21: mol_type = other DNA
ttgctagccaaccacaaccat

SEQ ID NO: 41665 - DNA, 23 bp, synthetic construct
  misc_feature 1..23: note = Synthetic Construct
  source 1..23: mol_type = other DNA
aacaccctgttatctgcttcaca

SEQ ID NO: 41666 - DNA, 25 bp, synthetic construct
  misc_feature 1..25: note = Synthetic Construct
  source 1..25: mol_type = other DNA
ggaggattctaggtcagcagcaaga

SEQ ID NO: 41667 - DNA, 25 bp, synthetic construct
  misc_feature 1..25: note = Synthetic Construct
  source 1..25: mol_type = other DNA
acacctctcagttatagagggacaa

SEQ ID NO: 41668 - DNA, 22 bp, synthetic construct
  misc_feature 1..22: note = Synthetic Construct
  source 1..22: mol_type = other DNA
ggggttgcagtggttggtttca

SEQ ID NO: 41669 - DNA, 23 bp, synthetic construct
  misc_feature 1..23: note = Synthetic Construct
  source 1..23: mol_type = other DNA
tgaactgcttgtctctggagttc

SEQ ID NO: 41670 - DNA, 22 bp, synthetic construct
  misc_feature 1..22: note = Synthetic Construct
  source 1..22: mol_type = other DNA
ccaagggctccctacctacact

SEQ ID NO: 41671 - DNA, 23 bp, synthetic construct
  misc_feature 1..23: note = Synthetic Construct
  source 1..23: mol_type = other DNA
ggccagagtgactcctttcaagt

SEQ ID NO: 41672 - DNA, 23 bp, synthetic construct
  misc_feature 1..23: note = Synthetic Construct
  source 1..23: mol_type = other DNA
gacttagagttggcaccgtgttg

SEQ ID NO: 41673 - DNA, 25 bp, synthetic construct
  misc_feature 1..25: note = Synthetic Construct
  source 1..25: mol_type = other DNA
ggagggaggaccacattgccaataa

SEQ ID NO: 41674 - DNA, 20 bp, synthetic construct
  misc_feature 1..20: note = Synthetic Construct
  source 1..20: mol_type = other DNA
tgttggggagccaggagaca

SEQ ID NO: 41675 - DNA, 21 bp, synthetic construct
  misc_feature 1..21: note = Synthetic Construct
  source 1..21: mol_type = other DNA
tgacttctcccctggctccaa

SEQ ID NO: 41676 - DNA, 23 bp, synthetic construct
  misc_feature 1..23: note = Synthetic Construct
  source 1..23: mol_type = other DNA
gccatctggctcccttggtaatg

SEQ ID NO: 41677 - DNA, 25 bp, synthetic construct
  misc_feature 1..25: note = Synthetic Construct
  source 1..25: mol_type = other DNA
cccattgtgcattacccaaagttag

SEQ ID NO: 41678 - DNA, 20 bp, synthetic construct
  misc_feature 1..20: note = Synthetic Construct
  source 1..20: mol_type = other DNA
tggcccgtgagggtgaatta

SEQ ID NO: 41679 - DNA, 20 bp, synthetic construct
  misc_feature 1..20: note = Synthetic Construct
  source 1..20: mol_type = other DNA
aaggagcaggggagggagta

SEQ ID NO: 41680 - DNA, 20 bp, synthetic construct
  misc_feature 1..20: note = Synthetic Construct
  source 1..20: mol_type = other DNA
tggccggcattgggtctttt

SEQ ID NO: 41681 - DNA, 23 bp, synthetic construct
  misc_feature 1..23: note = Synthetic Construct
  source 1..23: mol_type = other DNA
cgggtataacactgcacacaatc

SEQ ID NO: 41682 - DNA, 21 bp, synthetic construct
  misc_feature 1..21: note = Synthetic Construct
  source 1..21: mol_type = other DNA
actccaggggagctgagactt

SEQ ID NO: 41683 - DNA, 20 bp, synthetic construct
  misc_feature 1..20: note = Synthetic Construct
  source 1..20: mol_type = other DNA
aaggctggagctgggtgaga

SEQ ID NO: 41684 - DNA, 20 bp, synthetic construct
  misc_feature 1..20: note = Synthetic Construct
  source 1..20: mol_type = other DNA
tcactctgccccaggctgtt

SEQ ID NO: 41685 - DNA, 22 bp, synthetic construct
  misc_feature 1..22: note = Synthetic Construct
  source 1..22: mol_type = other DNA
agagttcacagtgtccctgcta

SEQ ID NO: 41686 - DNA, 25 bp, synthetic construct
  misc_feature 1..25: note = Synthetic Construct
  source 1..25: mol_type = other DNA
ggaacccaccatcctttctcctaga

SEQ ID NO: 41687 - DNA, 22 bp, synthetic construct
  misc_feature 1..22: note = Synthetic Construct
  source 1..22: mol_type = other DNA
gactcagaccctctcctgcata

SEQ ID NO: 41688 - DNA, 24 bp, synthetic construct
  misc_feature 1..24: note = Synthetic Construct
  source 1..24: mol_type = other DNA
agcttaccttcccatctgtgtttg

SEQ ID NO: 41689 - DNA, 28 bp, synthetic construct
  misc_feature 1..28: note = Synthetic Construct
  source 1..28: mol_type = other DNA
cacctatgtctgggcttagtagttaaag

SEQ ID NO: 41690 - DNA, 24 bp, synthetic construct
  misc_feature 1..24: note = Synthetic Construct
  source 1..24: mol_type = other DNA
ggagaaacaatggcaacactggta

SEQ ID NO: 41691 - DNA, 19 bp, synthetic construct
  misc_feature 1..19: note = Synthetic Construct
  source 1..19: mol_type = other DNA
gctgcagctctgggaagtt

SEQ ID NO: 41692 - DNA, 25 bp, synthetic construct
  misc_feature 1..25: note = Synthetic Construct
  source 1..25: mol_type = other DNA
ccatgtctaatgaccagctcgattc

SEQ ID NO: 41693 - DNA, 24 bp, synthetic construct
  misc_feature 1..24: note = Synthetic Construct
  source 1..24: mol_type = other DNA
ggcagccttcagtttagggccaat

SEQ ID NO: 41694 - DNA, 25 bp, synthetic construct
  misc_feature 1..25: note = Synthetic Construct
  source 1..25: mol_type = other DNA
cacacttctgaagaaaggcaagcat

SEQ ID NO: 41695 - DNA, 19 bp, synthetic construct
  misc_feature 1..19: note = Synthetic Construct
  source 1..19: mol_type = other DNA
ggacacccagcgtcgaaca

SEQ ID NO: 41696 - DNA, 21 bp, synthetic construct
  misc_feature 1..21: note = Synthetic Construct
  source 1..21: mol_type = other DNA
aacgcaggcatccagggagat

SEQ ID NO: 41697 - DNA, 19 bp, synthetic construct
  misc_feature 1..19: note = Synthetic Construct
  source 1..19: mol_type = other DNA
ccgactcccagcccaatca

SEQ ID NO: 41698 - DNA, 26 bp, synthetic construct
  misc_feature 1..26: note = Synthetic Construct
  source 1..26: mol_type = other DNA
ggacaaacctacacctacagaactac

SEQ ID NO: 41699 - DNA, 23 bp, synthetic construct
  misc_feature 1..23: note = Synthetic Construct
  source 1..23: mol_type = other DNA
tgcataggattgggctctctttc

SEQ ID NO: 41700 - DNA, 25 bp, synthetic construct
  misc_feature 1..25: note = Synthetic Construct
  source 1..25: mol_type = other DNA
gggaatgcaaaatgatgcactggaa

SEQ ID NO: 41701 - DNA, 25 bp, synthetic construct
  misc_feature 1..25: note = Synthetic Construct
  source 1..25: mol_type = other DNA
cccagatatgtgtggaggggtaaag

SEQ ID NO: 41702 - DNA, 30 bp, synthetic construct
  misc_feature 1..30: note = Synthetic Construct
  source 1..30: mol_type = other DNA
ctggctccaaatatattgtcattcccattg

SEQ ID NO: 41703 - DNA, 27 bp, synthetic construct
  misc_feature 1..27: note = Synthetic Construct
  source 1..27: mol_type = other DNA
gcagttttagcgataatccaacccaaa

SEQ ID NO: 41704 - DNA, 26 bp, synthetic construct
  misc_feature 1..26: note = Synthetic Construct
  source 1..26: mol_type = other DNA
gggtgcacattcttcacaggttgtag

SEQ ID NO: 41705 - DNA, 19 bp, synthetic construct
  misc_feature 1..19: note = Synthetic Construct
  source 1..19: mol_type = other DNA
ggggtagcatgccctgaac

SEQ ID NO: 41706 - DNA, 23 bp, synthetic construct
  misc_feature 1..23: note = Synthetic Construct
  source 1..23: mol_type = other DNA
gcatctatggcctcatgggagtt

SEQ ID NO: 41707 - DNA, 20 bp, synthetic construct
  misc_feature 1..20: note = Synthetic Construct
  source 1..20: mol_type = other DNA
ggccttgctctgtgtgacat

SEQ ID NO: 41708 - DNA, 23 bp, synthetic construct
  misc_feature 1..23: note = Synthetic Construct
  source 1..23: mol_type = other DNA
tctcatctgtgccagatttggtt

SEQ ID NO: 41709 - DNA, 22 bp, synthetic construct
  misc_feature 1..22: note = Synthetic Construct
  source 1..22: mol_type = other DNA
cttgaagcccagctcagtcatc

SEQ ID NO: 41710 - DNA, 21 bp, synthetic construct
  misc_feature 1..21: note = Synthetic Construct
  source 1..21: mol_type = other DNA
ggagggcagtggctgaagtta

SEQ ID NO: 41711 - DNA, 25 bp, synthetic construct
  misc_feature 1..25: note = Synthetic Construct
  source 1..25: mol_type = other DNA
gatattttgagtcagccagccattg

SEQ ID NO: 41712 - DNA, 22 bp, synthetic construct
  misc_feature 1..22: note = Synthetic Construct
  source 1..22: mol_type = other DNA
ccaagaggcaggtggctgtaat

SEQ ID NO: 41713 - DNA, 25 bp, synthetic construct
  misc_feature 1..25: note = Synthetic Construct
  source 1..25: mol_type = other DNA
catagaactgatctgtgtgggacaa

SEQ ID NO: 41714 - DNA, 20 bp, synthetic construct
  misc_feature 1..20: note = Synthetic Construct
  source 1..20: mol_type = other DNA
gctgtagtggcgttgggaaa

SEQ ID NO: 41715 - DNA, 21 bp, synthetic construct
  misc_feature 1..21: note = Synthetic Construct
  source 1..21: mol_type = other DNA
tttgctttggctgagggagaa

SEQ ID NO: 41716 - DNA, 20 bp, synthetic construct
  misc_feature 1..20: note = Synthetic Construct
  source 1..20: mol_type = other DNA
tgtggaccaggtggaagtga

SEQ ID NO: 41717 - DNA, 20 bp, synthetic construct
  misc_feature 1..20: note = Synthetic Construct
  source 1..20: mol_type = other DNA
gggtgcaagctttcctgttg

SEQ ID NO: 41718 - DNA, 22 bp, synthetic construct
  misc_feature 1..22: note = Synthetic Construct
  source 1..22: mol_type = other DNA
cactgtctgagtgcctgctgtt

SEQ ID NO: 41719 - DNA, 30 bp, synthetic construct
  misc_feature 1..30: note = Synthetic Construct
  source 1..30: mol_type = other DNA
ccaagacataaggaaatgaagacctactct

SEQ ID NO: 41720 - DNA, 21 bp, synthetic construct
  misc_feature 1..21: note = Synthetic Construct
  source 1..21: mol_type = other DNA
ttgcctcctacctcccaggtt

SEQ ID NO: 41721 - DNA, 24 bp, synthetic construct
  misc_feature 1..24: note = Synthetic Construct
  source 1..24: mol_type = other DNA
cccacactctcctctccactttgt

SEQ ID NO: 41722 - DNA, 22 bp, synthetic construct
  misc_feature 1..22: note = Synthetic Construct
  source 1..22: mol_type = other DNA
gagaactccacaccgaccttga

SEQ ID NO: 41723 - DNA, 19 bp, synthetic construct
  misc_feature 1..19: note = Synthetic Construct
  source 1..19: mol_type = other DNA
cccaaggtcagcccacaga

SEQ ID NO: 41724 - DNA, 27 bp, synthetic construct
  misc_feature 1..27: note = Synthetic Construct
  source 1..27: mol_type = other DNA
gcctgacaaactagtccaaggaagata

SEQ ID NO: 41725 - DNA, 22 bp, synthetic construct
  misc_feature 1..22: note = Synthetic Construct
  source 1..22: mol_type = other DNA
ccagaagatgtgggaggccttt

SEQ ID NO: 41726 - DNA, 24 bp, synthetic construct
  misc_feature 1..24: note = Synthetic Construct
  source 1..24: mol_type = other DNA
gaccagtgtttaaaaggccaagtt

SEQ ID NO: 41727 - DNA, 23 bp, synthetic construct
  misc_feature 1..23: note = Synthetic Construct
  source 1..23: mol_type = other DNA
ccagaagggacccctgaaatcat

SEQ ID NO: 41728 - DNA, 19 bp, synthetic construct
  misc_feature 1..19: note = Synthetic Construct
  source 1..19: mol_type = other DNA
aacctggcaggcagagaca

SEQ ID NO: 41729 - DNA, 26 bp, synthetic construct
  misc_feature 1..26: note = Synthetic Construct
  source 1..26: mol_type = other DNA
cacaagtcaaggtctcacttccaaac

SEQ ID NO: 41730 - DNA, 23 bp, synthetic construct
  misc_feature 1..23: note = Synthetic Construct
  source 1..23: mol_type = other DNA
cctggggtcatctttacctcttc

SEQ ID NO: 41731 - DNA, 26 bp, synthetic construct
  misc_feature 1..26: note = Synthetic Construct
  source 1..26: mol_type = other DNA
tctggctagctgtgttatctaggatt

SEQ ID NO: 41732 - DNA, 20 bp, synthetic construct
  misc_feature 1..20: note = Synthetic Construct
  source 1..20: mol_type = other DNA
agctcgagacggccacattg

SEQ ID NO: 41733 - DNA, 20 bp, synthetic construct
  misc_feature 1..20: note = Synthetic Construct
  source 1..20: mol_type = other DNA
cggctgccctacaaatgtct

SEQ ID NO: 41734 - DNA, 23 bp, synthetic construct
  misc_feature 1..23: note = Synthetic Construct
  source 1..23: mol_type = other DNA
aacaagttcctcaactggggttt

SEQ ID NO: 41735 - DNA, 22 bp, synthetic construct
  misc_feature 1..22: note = Synthetic Construct
  source 1..22: mol_type = other DNA
ggagggagcaggaagcatgtaa

SEQ ID NO: 41736 - DNA, 20 bp, synthetic construct
  misc_feature 1..20: note = Synthetic Construct
  source 1..20: mol_type = other DNA
agctgggtgcacctgtggaa

SEQ ID NO: 41737 - DNA, 22 bp, synthetic construct
  misc_feature 1..22: note = Synthetic Construct
  source 1..22: mol_type = other DNA
cctagccagaggggaattgtca

SEQ ID NO: 41738 - DNA, 24 bp, synthetic construct
  misc_feature 1..24: note = Synthetic Construct
  source 1..24: mol_type = other DNA
acatgtttgaaatgggtggtgttc

SEQ ID NO: 41739 - DNA, 23 bp, synthetic construct
  misc_feature 1..23: note = Synthetic Construct
  source 1..23: mol_type = other DNA
tgtgagtaactgagagggtctga

SEQ ID NO: 41740 - DNA, 24 bp, synthetic construct
  misc_feature 1..24: note = Synthetic Construct
  source 1..24: mol_type = other DNA
ggtaccatcctgggacaccaatct

SEQ ID NO: 41741 - DNA, 19 bp, synthetic construct
  misc_feature 1..19: note = Synthetic Construct
  source 1..19: mol_type = other DNA
attggcccacgctggtaga

SEQ ID NO: 41742 - DNA, 22 bp, synthetic construct
  misc_feature 1..22: note = Synthetic Construct
  source 1..22: mol_type = other DNA
cactttggccagcagagagtca

SEQ ID NO: 41743 - DNA, 20 bp, synthetic construct
  misc_feature 1..20: note = Synthetic Construct
  source 1..20: mol_type = other DNA
agtggaccagccagcatagt

SEQ ID NO: 41744 - DNA, 26 bp, synthetic construct
  misc_feature 1..26: note = Synthetic Construct
  source 1..26: mol_type = other DNA
ggacaactcctctctcaaacacttag

SEQ ID NO: 41745 - DNA, 18 bp, synthetic construct
  misc_feature 1..18: note = Synthetic Construct
  source 1..18: mol_type = other DNA
tcgtgctcagcgctccaa

SEQ ID NO: 41746 - DNA, 22 bp, synthetic construct
  misc_feature 1..22: note = Synthetic Construct
  source 1..22: mol_type = other DNA
tggacctccgtgcctatcagtt

SEQ ID NO: 41747 - DNA, 22 bp, synthetic construct
  misc_feature 1..22: note = Synthetic Construct
  source 1..22: mol_type = other DNA
tggtacctcggggtcctacagt

SEQ ID NO: 41748 - DNA, 21 bp, synthetic construct
  misc_feature 1..21: note = Synthetic Construct
  source 1..21: mol_type = other DNA
caacctccctgacatgtgctt

SEQ ID NO: 41749 - DNA, 25 bp, synthetic construct
  misc_feature 1..25: note = Synthetic Construct
  source 1..25: mol_type = other DNA
gtaaattagcctgtgccctaactga

SEQ ID NO: 41750 - DNA, 20 bp, synthetic construct
  misc_feature 1..20: note = Synthetic Construct
  source 1..20: mol_type = other DNA
acatctgcacagcccctgta

SEQ ID NO: 41751 - DNA, 25 bp, synthetic construct
  misc_feature 1..25: note = Synthetic Construct
  source 1..25: mol_type = other DNA
cacaccttcacatttcagtccttga

SEQ ID NO: 41752 - DNA, 25 bp, synthetic construct
  misc_feature 1..25: note = Synthetic Construct
  source 1..25: mol_type = other DNA
gtcatttctcccactactccctatg

SEQ ID NO: 41753 - DNA, 19 bp, synthetic construct
  misc_feature 1..19: note = Synthetic Construct
  source 1..19: mol_type = other DNA
tgtgtcccagtgcccttgt

SEQ ID NO: 41754 - DNA, 26 bp, synthetic construct
  misc_feature 1..26: note = Synthetic Construct
  source 1..26: mol_type = other DNA
ggtgggacaccatcctccagtatatc

SEQ ID NO: 41755 - DNA, 22 bp, synthetic construct
  misc_feature 1..22: note = Synthetic Construct
  source 1..22: mol_type = other DNA
ctgtctcttggcttccctgctt

SEQ ID NO: 41756 - DNA, 26 bp, synthetic construct
  misc_feature 1..26: note = Synthetic Construct
  source 1..26: mol_type = other DNA
gcctaagcatggaactgacataggat

SEQ ID NO: 41757 - DNA, 24 bp, synthetic construct
  misc_feature 1..24: note = Synthetic Construct
  source 1..24: mol_type = other DNA
tggctgacttacagagctgaattt

SEQ ID NO: 41758 - DNA, 27 bp, synthetic construct
  misc_feature 1..27: note = Synthetic Construct
  source 1..27: mol_type = other DNA
ccttatctctgcaaatgtatgccttgt

SEQ ID NO: 41759 - DNA, 24 bp, synthetic construct
  misc_feature 1..24: note = Synthetic Construct
  source 1..24: mol_type = other DNA
ccctctttgctacatgcccagaca

SEQ ID NO: 41760 - DNA, 20 bp, synthetic construct
  misc_feature 1..20: note = Synthetic Construct
  source 1..20: mol_type = other DNA
gttcttgccatggggcttct

SEQ ID NO: 41761 - DNA, 20 bp, synthetic construct
  misc_feature 1..20: note = Synthetic Construct
  source 1..20: mol_type = other DNA
gcagctgtgcctgacaaagt

SEQ ID NO: 41762 - DNA, 22 bp, synthetic construct
  misc_feature 1..22: note = Synthetic Construct
  source 1..22: mol_type = other DNA
gcccaccaaagaggcaaggaaa

SEQ ID NO: 41763 - DNA, 22 bp, synthetic construct
  misc_feature 1..22: note = Synthetic Construct
  source 1..22: mol_type = other DNA
cctacctcaaaggggtgcagtt

SEQ ID NO: 41764 - DNA, 22 bp, synthetic construct
  misc_feature 1..22: note = Synthetic Construct
  source 1..22: mol_type = other DNA
gcacaaaggctgctgttacaag

SEQ ID NO: 41765 - DNA, 20 bp, synthetic construct
  misc_feature 1..20: note = Synthetic Construct
  source 1..20: mol_type = other DNA
acctgtgcagagaccaggaa

SEQ ID NO: 41766 - DNA, 23 bp, synthetic construct
  misc_feature 1..23: note = Synthetic Construct
  source 1..23: mol_type = other DNA
gacccatctaaaggcagtcactt

SEQ ID NO: 41767 - DNA, 19 bp, synthetic construct
  misc_feature 1..19: note = Synthetic Construct
  source 1..19: mol_type = other DNA
accggactgagcggctact

SEQ ID NO: 41768 - DNA, 24 bp, synthetic construct
  misc_feature 1..24: note = Synthetic Construct
  source 1..24: mol_type = other DNA
gccacctgcaatataaggatctga

SEQ ID NO: 41769 - DNA, 24 bp, synthetic construct
  misc_feature 1..24: note = Synthetic Construct
  source 1..24: mol_type = other DNA
cctcaggctaatgctaggttcaag

SEQ ID NO: 41770 - DNA, 23 bp, synthetic construct
  misc_feature 1..23: note = Synthetic Construct
  source 1..23: mol_type = other DNA
gtcattggagctggtctcaggaa

SEQ ID NO: 41771 - DNA, 19 bp, synthetic construct
  misc_feature 1..19: note = Synthetic Construct
  source 1..19: mol_type = other DNA
cagctgttgtccccagtgt

SEQ ID NO: 41772 - DNA, 20 bp, synthetic construct
  misc_feature 1..20: note = Synthetic Construct
  source 1..20: mol_type = other DNA
gtgaccagccctcaacaaga

SEQ ID NO: 41773 - DNA, 22 bp, synthetic construct
  misc_feature 1..22: note = Synthetic Construct
  source 1..22: mol_type = other DNA
cataggggcagattcaccatgt

SEQ ID NO: 41774 - DNA, 23 bp, synthetic construct
  misc_feature 1..23: note = Synthetic Construct
  source 1..23: mol_type = other DNA
aagggtaggagcagatcacctaa

SEQ ID NO: 41775 - DNA, 21 bp, synthetic construct
  misc_feature 1..21: note = Synthetic Construct
  source 1..21: mol_type = other DNA
ccgagacatttggctgacagt

SEQ ID NO: 41776 - DNA, 25 bp, synthetic construct
  misc_feature 1..25: note = Synthetic Construct
  source 1..25: mol_type = other DNA
acttctcctgaccaaggaaaacttc

SEQ ID NO: 41777 - DNA, 24 bp, synthetic construct
  misc_feature 1..24: note = Synthetic Construct
  source 1..24: mol_type = other DNA
cctttttggactggcatgtgtcta

SEQ ID NO: 41778 - DNA, 25 bp, synthetic construct
  misc_feature 1..25: note = Synthetic Construct
  source 1..25: mol_type = other DNA
ggagaagagaccatagggagcaaga

SEQ ID NO: 41779 - DNA, 24 bp, synthetic construct
  misc_feature 1..24: note = Synthetic Construct
  source 1..24: mol_type = other DNA
gggtcagccttggtaagtgtccat

SEQ ID NO: 41780 - DNA, 25 bp, synthetic construct
  misc_feature 1..25: note = Synthetic Construct
  source 1..25: mol_type = other DNA
catgcttattgtaaaagccctgcaa

SEQ ID NO: 41781 - DNA, 23 bp, synthetic construct
  misc_feature 1..23: note = Synthetic Construct
  source 1..23: mol_type = other DNA
ggatgagggaaggtgttcagaga

SEQ ID NO: 41782 - DNA, 22 bp, synthetic construct
  misc_feature 1..22: note = Synthetic Construct
  source 1..22: mol_type = other DNA
tggggaatcacctctccctcta

SEQ ID NO: 41783 - DNA, 28 bp, synthetic construct
  misc_feature 1..28: note = Synthetic Construct
  source 1..28: mol_type = other DNA
ggagaaccaagagacagaagaaatccaa

SEQ ID NO: 41784 - DNA, 20 bp, synthetic construct
  misc_feature 1..20: note = Synthetic Construct
  source 1..20: mol_type = other DNA
ccatggcacccaaccacttt

SEQ ID NO: 41785 - DNA, 22 bp, synthetic construct
  misc_feature 1..22: note = Synthetic Construct
  source 1..22: mol_type = other DNA
cctcagggagtagcctagaagt

SEQ ID NO: 41786 - DNA, 25 bp, synthetic construct
  misc_feature 1..25: note = Synthetic Construct
  source 1..25: mol_type = other DNA
caaaattaacttggccatgctgaga

SEQ ID NO: 41787 - DNA, 24 bp, synthetic construct
  misc_feature 1..24: note = Synthetic Construct
  source 1..24: mol_type = other DNA
gtgaatgcttccagtggagttatg

SEQ ID NO: 41788 - DNA, 28 bp, synthetic construct
  misc_feature 1..28: note = Synthetic Construct
  source 1..28: mol_type = other DNA
gagaaggtattagcaacacctgaagtag

SEQ ID NO: 41789 - DNA, 26 bp, synthetic construct
  misc_feature 1..26: note = Synthetic Construct
  source 1..26: mol_type = other DNA
gaatactgaatccatggggatacctt

SEQ ID NO: 41790 - DNA, 19 bp, synthetic construct
  misc_feature 1..19: note = Synthetic Construct
  source 1..19: mol_type = other DNA
tggtggtctggggcaagtt

SEQ ID NO: 41791 - DNA, 26 bp, synthetic construct
  misc_feature 1..26: note = Synthetic Construct
  source 1..26: mol_type = other DNA
ccttgaaatccacatatgccagtcta

SEQ ID NO: 41792 - DNA, 24 bp, synthetic construct
  misc_feature 1..24: note = Synthetic Construct
  source 1..24: mol_type = other DNA
ccctctgtctctgactgctaccaa

SEQ ID NO: 41793 - DNA, 19 bp, synthetic construct
  misc_feature 1..19: note = Synthetic Construct
  source 1..19: mol_type = other DNA
agggtaggccctcccaagt

SEQ ID NO: 41794 - DNA, 22 bp, synthetic construct
  misc_feature 1..22: note = Synthetic Construct
  source 1..22: mol_type = other DNA
gcctgaagaagccagagacgtt

SEQ ID NO: 41795 - DNA, 20 bp, synthetic construct
  misc_feature 1..20: note = Synthetic Construct
  source 1..20: mol_type = other DNA
tggggtccagtcctttgtgt

SEQ ID NO: 41796 - DNA, 20 bp, synthetic construct
  misc_feature 1..20: note = Synthetic Construct
  source 1..20: mol_type = other DNA
accctacccaacctggatgt

SEQ ID NO: 41797 - DNA, 23 bp, synthetic construct
  misc_feature 1..23: note = Synthetic Construct
  source 1..23: mol_type = other DNA
gtctttatgggtgtggctctgaa

SEQ ID NO: 41798 - DNA, 26 bp, synthetic construct
  misc_feature 1..26: note = Synthetic Construct
  source 1..26: mol_type = other DNA
cctgatctctacatattggcatgact

SEQ ID NO: 41799 - DNA, 25 bp, synthetic construct
  misc_feature 1..25: note = Synthetic Construct
  source 1..25: mol_type = other DNA
gagggtaatagtagctcccttgcta

SEQ ID NO: 41800 - DNA, 25 bp, synthetic construct
  misc_feature 1..25: note = Synthetic Construct
  source 1..25: mol_type = other DNA
ggaaaggttacaagacttgcacaga

SEQ ID NO: 41801 - DNA, 22 bp, synthetic construct
  misc_feature 1..22: note = Synthetic Construct
  source 1..22: mol_type = other DNA
gagaactgggtgtcgaaaggat

SEQ ID NO: 41802 - DNA, 27 bp, synthetic construct
  misc_feature 1..27: note = Synthetic Construct
  source 1..27: mol_type = other DNA
gtctgcaaagcctccaatatttacgaa

SEQ ID NO: 41803 - DNA, 29 bp, synthetic construct
  misc_feature 1..29: note = Synthetic Construct
  source 1..29: mol_type = other DNA
gcaagcaagcaattaagaaggtaccaaac

SEQ ID NO: 41804 - DNA, 28 bp, synthetic construct
  misc_feature 1..28: note = Synthetic Construct
  source 1..28: mol_type = other DNA
cccctagaaattagtcagacccctattc

SEQ ID NO: 41805 - DNA, 20 bp, synthetic construct
  misc_feature 1..20: note = Synthetic Construct
  source 1..20: mol_type = other DNA
ccacatcccaaggacgtcaa

SEQ ID NO: 41806 - DNA, 20 bp, synthetic construct
  misc_feature 1..20: note = Synthetic Construct
  source 1..20: mol_type = other DNA
tgcctgccactgagaccaaa

SEQ ID NO: 41807 - DNA, 20 bp, synthetic construct
  misc_feature 1..20: note = Synthetic Construct
  source 1..20: mol_type = other DNA
ccaggccattaccgctgaga

SEQ ID NO: 41808 - DNA, 19 bp, synthetic construct
  misc_feature 1..19: note = Synthetic Construct
  source 1..19: mol_type = other DNA
ttccatgccaccgggctaa

SEQ ID NO: 41809 - DNA, 26 bp, synthetic construct
  misc_feature 1..26: note = Synthetic Construct
  source 1..26: mol_type = other DNA
cacaggtatgtttgaaagcaccaagt

SEQ ID NO: 41810 - DNA, 23 bp, synthetic construct
  misc_feature 1..23: note = Synthetic Construct
  source 1..23: mol_type = other DNA
atttgagatgggtggatgcttca

SEQ ID NO: 41811 - DNA, 24 bp, synthetic construct
  misc_feature 1..24: note = Synthetic Construct
  source 1..24: mol_type = other DNA
aagagaaagtcgctagtcacaagt

SEQ ID NO: 41812 - DNA, 20 bp, synthetic construct
  misc_feature 1..20: note = Synthetic Construct
  source 1..20: mol_type = other DNA
gtcctgcacagctgttctct

SEQ ID NO: 41813 - DNA, 23 bp, synthetic construct
  misc_feature 1..23: note = Synthetic Construct
  source 1..23: mol_type = other DNA
gccatctaactccctagctcaac

SEQ ID NO: 41814 - DNA, 25 bp, synthetic construct
  misc_feature 1..25: note = Synthetic Construct
  source 1..25: mol_type = other DNA
gccacgtgtataccaaagggagata

SEQ ID NO: 41815 - DNA, 25 bp, synthetic construct
  misc_feature 1..25: note = Synthetic Construct
  source 1..25: mol_type = other DNA
caagtcaaggttttgagtggtggta

SEQ ID NO: 41816 - DNA, 23 bp, synthetic construct
  misc_feature 1..23: note = Synthetic Construct
  source 1..23: mol_type = other DNA
agatgcctaagctagaggcaaga

SEQ ID NO: 41817 - DNA, 24 bp, synthetic construct
  misc_feature 1..24: note = Synthetic Construct
  source 1..24: mol_type = other DNA
ccaccctgagaaggttgggtaaga

SEQ ID NO: 41818 - DNA, 24 bp, synthetic construct
  misc_feature 1..24: note = Synthetic Construct
  source 1..24: mol_type = other DNA
catggtactggattggcattgttt

SEQ ID NO: 41819 - DNA, 23 bp, synthetic construct
  misc_feature 1..23: note = Synthetic Construct
  source 1..23: mol_type = other DNA
gacaaacagtggggtttttgtga

SEQ ID NO: 41820 - DNA, 24 bp, synthetic construct
  misc_feature 1..24: note = Synthetic Construct
  source 1..24: mol_type = other DNA
ccactagggacaaaacttcactca

SEQ ID NO: 41821 - DNA, 25 bp, synthetic construct
  misc_feature 1..25: note = Synthetic Construct
  source 1..25: mol_type = other DNA
cccatgcttttcactaggcaccata

SEQ ID NO: 41822 - DNA, 24 bp, synthetic construct
  misc_feature 1..24: note = Synthetic Construct
  source 1..24: mol_type = other DNA
gactgagtaaacattcggggctaa

SEQ ID NO: 41823 - DNA, 20 bp, synthetic construct
  misc_feature 1..20: note = Synthetic Construct
  source 1..20: mol_type = other DNA
gacatgagcgaggccattgt

SEQ ID NO: 41824 - DNA, 19 bp, synthetic construct
  misc_feature 1..19: note = Synthetic Construct
  source 1..19: mol_type = other DNA
gctaggctcagggctgcat

SEQ ID NO: 41825 - DNA, 20 bp, synthetic construct
  misc_feature 1..20: note = Synthetic Construct
  source 1..20: mol_type = other DNA
actggagcacaacccagcat

SEQ ID NO: 41826 - DNA, 23 bp, synthetic construct
  misc_feature 1..23: note = Synthetic Construct
  source 1..23: mol_type = other DNA
tgtttgtaaaaccggggcaaaac

SEQ ID NO: 41827 - DNA, 25 bp, synthetic construct
  misc_feature 1..25: note = Synthetic Construct
  source 1..25: mol_type = other DNA
gcctctctccaaggaatcagcattg

SEQ ID NO: 41828 - DNA, 21 bp, synthetic construct
  misc_feature 1..21: note = Synthetic Construct
  source 1..21: mol_type = other DNA
cagcccatggcctaaaggatt

SEQ ID NO: 41829 - DNA, 26 bp, synthetic construct
  misc_feature 1..26: note = Synthetic Construct
  source 1..26: mol_type = other DNA
gctccattcagtcaagagctccactt

SEQ ID NO: 41830 - DNA, 21 bp, synthetic construct
  misc_feature 1..21: note = Synthetic Construct
  source 1..21: mol_type = other DNA
gagtcgcacacatgtccagtt

SEQ ID NO: 41831 - DNA, 22 bp, synthetic construct
  misc_feature 1..22: note = Synthetic Construct
  source 1..22: mol_type = other DNA
ggtgctccctccaccttaaatg

SEQ ID NO: 41832 - DNA, 22 bp, synthetic construct
  misc_feature 1..22: note = Synthetic Construct
  source 1..22: mol_type = other DNA
ttgtgcattttggggttggttt

SEQ ID NO: 41833 - DNA, 21 bp, synthetic construct
  misc_feature 1..21: note = Synthetic Construct
  source 1..21: mol_type = other DNA
gtggaaatgcagcaccacact

SEQ ID NO: 41834 - DNA, 27 bp, synthetic construct
  misc_feature 1..27: note = Synthetic Construct
  source 1..27: mol_type = other DNA
ggcctccatctataggtcagttacttg

SEQ ID NO: 41835 - DNA, 23 bp, synthetic construct
  misc_feature 1..23: note = Synthetic Construct
  source 1..23: mol_type = other DNA
gtggctgaaagtgggagaactga

SEQ ID NO: 41836 - DNA, 25 bp, synthetic construct
  misc_feature 1..25: note = Synthetic Construct
  source 1..25: mol_type = other DNA
gagagcccaaattcagaggtgttag

SEQ ID NO: 41837 - DNA, 21 bp, synthetic construct
  misc_feature 1..21: note = Synthetic Construct
  source 1..21: mol_type = other DNA
aagtccaagggtccgcgaaga

SEQ ID NO: 41838 - DNA, 22 bp, synthetic construct
  misc_feature 1..22: note = Synthetic Construct
  source 1..22: mol_type = other DNA
tcccttactgcagtggggtttg

SEQ ID NO: 41839 - DNA, 25 bp, synthetic construct
  misc_feature 1..25: note = Synthetic Construct
  source 1..25: mol_type = other DNA
gtcctcgagctaagcttggtttttg

SEQ ID NO: 41840 - DNA, 21 bp, synthetic construct
  misc_feature 1..21: note = Synthetic Construct
  source 1..21: mol_type = other DNA
tcggaggagtgctttgcatac

SEQ ID NO: 41841 - DNA, 20 bp, synthetic construct
  misc_feature 1..20: note = Synthetic Construct
  source 1..20: mol_type = other DNA
agttacaggcggggtaccaa

SEQ ID NO: 41842 - DNA, 20 bp, synthetic construct
  misc_feature 1..20: note = Synthetic Construct
  source 1..20: mol_type = other DNA
agggacagcgggtcaacatt

SEQ ID NO: 41843 - DNA, 24 bp, synthetic construct
  misc_feature 1..24: note = Synthetic Construct
  source 1..24: mol_type = other DNA
gcaacgaaatgactgtgtttgaga

SEQ ID NO: 41844 - DNA, 22 bp, synthetic construct
  misc_feature 1..22: note = Synthetic Construct
  source 1..22: mol_type = other DNA
gtgttgggaggtggtaccctta

SEQ ID NO: 41845 - DNA, 27 bp, synthetic construct
  misc_feature 1..27: note = Synthetic Construct
  source 1..27: mol_type = other DNA
gccatttatgactcctagttgctgaag

SEQ ID NO: 41846 - DNA, 26 bp, synthetic construct
  misc_feature 1..26: note = Synthetic Construct
  source 1..26: mol_type = other DNA
ggcttcaggaatggtcctataaccta

SEQ ID NO: 41847 - DNA, 24 bp, synthetic construct
  misc_feature 1..24: note = Synthetic Construct
  source 1..24: mol_type = other DNA
gtgtttctcaaggggagagacatt

SEQ ID NO: 41848 - DNA, 22 bp, synthetic construct
  misc_feature 1..22: note = Synthetic Construct
  source 1..22: mol_type = other DNA
ccgtgccaaacaaagggagaag

SEQ ID NO: 41849 - DNA, 22 bp, synthetic construct
  misc_feature 1..22: note = Synthetic Construct
  source 1..22: mol_type = other DNA
tcccagaactcagtcccacgtt

SEQ ID NO: 41850 - DNA, 20 bp, synthetic construct
  misc_feature 1..20: note = Synthetic Construct
  source 1..20: mol_type = other DNA
aggtggctgctgaactctca

SEQ ID NO: 41851 - DNA, 24 bp, synthetic construct
  misc_feature 1..24: note = Synthetic Construct
  source 1..24: mol_type = other DNA
gaggtttgtgcagagaagctaatg

SEQ ID NO: 41852 - DNA, 24 bp, synthetic construct
  misc_feature 1..24: note = Synthetic Construct
  source 1..24: mol_type = other DNA
tgtttaaggggtgagatggagtca

SEQ ID NO: 41853 - DNA, 24 bp, synthetic construct
  misc_feature 1..24: note = Synthetic Construct
  source 1..24: mol_type = other DNA
tgaccaatcagttccactctttga

SEQ ID NO: 41854 - DNA, 20 bp, synthetic construct
  misc_feature 1..20: note = Synthetic Construct
  source 1..20: mol_type = other DNA
ccacccggcaaccattttca

SEQ ID NO: 41855 - DNA, 22 bp, synthetic construct
  misc_feature 1..22: note = Synthetic Construct
  source 1..22: mol_type = other DNA
gatgtgggcttgattggggaaa

SEQ ID NO: 41856 - DNA, 24 bp, synthetic construct
  misc_feature 1..24: note = Synthetic Construct
  source 1..24: mol_type = other DNA
gcacttgaccctggttatcaggaa

SEQ ID NO: 41857 - DNA, 20 bp, synthetic construct
  misc_feature 1..20: note = Synthetic Construct
  source 1..20: mol_type = other DNA
tggtggatgacggagcaact

SEQ ID NO: 41858 - DNA, 18 bp, synthetic construct
  misc_feature 1..18: note = Synthetic Construct
  source 1..18: mol_type = other DNA
tggccagagccaggtaca

SEQ ID NO: 41859 - DNA, 22 bp, synthetic construct
  misc_feature 1..22: note = Synthetic Construct
  source 1..22: mol_type = other DNA
aggcctggaggggtttaggaat

SEQ ID NO: 41860 - DNA, 23 bp, synthetic construct
  misc_feature 1..23: note = Synthetic Construct
  source 1..23: mol_type = other DNA
gctcttgacttccccttcctaca

SEQ ID NO: 41861 - DNA, 20 bp, synthetic construct
  misc_feature 1..20: note = Synthetic Construct
  source 1..20: mol_type = other DNA
acagtcacacaggccactct

SEQ ID NO: 41862 - DNA, 22 bp, synthetic construct
  misc_feature 1..22: note = Synthetic Construct
  source 1..22: mol_type = other DNA
agctaactcatgtggctgttgt

SEQ ID NO: 41863 - DNA, 23 bp, synthetic construct
  misc_feature 1..23: note = Synthetic Construct
  source 1..23: mol_type = other DNA
ctggtaggaaggcctgcttcaaa

SEQ ID NO: 41864 - DNA, 25 bp, synthetic construct
  misc_feature 1..25: note = Synthetic Construct
  source 1..25: mol_type = other DNA
gctgttgttcaatggctctcagcta

SEQ ID NO: 41865 - DNA, 23 bp, synthetic construct
  misc_feature 1..23: note = Synthetic Construct
  source 1..23: mol_type = other DNA
cggcacttgcagtttggtgaatg

SEQ ID NO: 41866 - DNA, 26 bp, synthetic construct
  misc_feature 1..26: note = Synthetic Construct
  source 1..26: mol_type = other DNA
ctctaggttgtcttatagctgccatt

SEQ ID NO: 41867 - DNA, 21 bp, synthetic construct
  misc_feature 1..21: note = Synthetic Construct
  source 1..21: mol_type = other DNA
gctctgccccaggtcttttca

SEQ ID NO: 41868 - DNA, 24 bp, synthetic construct
  misc_feature 1..24: note = Synthetic Construct
  source 1..24: mol_type = other DNA
gcttctgccctttagaaagcttga

SEQ ID NO: 41869 - DNA, 18 bp, synthetic construct
  misc_feature 1..18: note = Synthetic Construct
  source 1..18: mol_type = other DNA
cctgcccactgcaagtca

SEQ ID NO: 41870 - DNA, 23 bp, synthetic construct
  misc_feature 1..23: note = Synthetic Construct
  source 1..23: mol_type = other DNA
gttaaacacacggcagtcttcaa

SEQ ID NO: 41871 - DNA, 20 bp, synthetic construct
  misc_feature 1..20: note = Synthetic Construct
  source 1..20: mol_type = other DNA
tgtacgatgggtgggtgctt

SEQ ID NO: 41872 - DNA, 23 bp, synthetic construct
  misc_feature 1..23: note = Synthetic Construct
  source 1..23: mol_type = other DNA
gccagtgtaacagatgcaacctt

SEQ ID NO: 41873 - DNA, 24 bp, synthetic construct
  misc_feature 1..24: note = Synthetic Construct
  source 1..24: mol_type = other DNA
ctgttgccagtgatactggaagtt

SEQ ID NO: 41874 - DNA, 24 bp, synthetic construct
  misc_feature 1..24: note = Synthetic Construct
  source 1..24: mol_type = other DNA
gcagaggcaagagtaaaggggaat

SEQ ID NO: 41875 - DNA, 22 bp, synthetic construct
  misc_feature 1..22: note = Synthetic Construct
  source 1..22: mol_type = other DNA
gcttcctggatgcaagccactt

SEQ ID NO: 41876 - DNA, 25 bp, synthetic construct
  misc_feature 1..25: note = Synthetic Construct
  source 1..25: mol_type = other DNA
ggaatgaagcttctgtgtgaaggat

SEQ ID NO: 41877 - DNA, 22 bp, synthetic construct
  misc_feature 1..22: note = Synthetic Construct
  source 1..22: mol_type = other DNA
cgtgttagcagagaagggaact

SEQ ID NO: 41878 - DNA, 26 bp, synthetic construct
  misc_feature 1..26: note = Synthetic Construct
  source 1..26: mol_type = other DNA
cccacgaccaataacagtatggatca

SEQ ID NO: 41879 - DNA, 24 bp, synthetic construct
  misc_feature 1..24: note = Synthetic Construct
  source 1..24: mol_type = other DNA
ggtgtggtaggtatcacagcaaca

SEQ ID NO: 41880 - DNA, 25 bp, synthetic construct
  misc_feature 1..25: note = Synthetic Construct
  source 1..25: mol_type = other DNA
tccctcaagtttgacatctgttgtt

SEQ ID NO: 41881 - DNA, 20 bp, synthetic construct
  misc_feature 1..20: note = Synthetic Construct
  source 1..20: mol_type = other DNA
tgatctgcctctgcccatct

SEQ ID NO: 41882 - DNA, 20 bp, synthetic construct
  misc_feature 1..20: note = Synthetic Construct
  source 1..20: mol_type = other DNA
gagccatctgctgctgaagt

SEQ ID NO: 41883 - DNA, 20 bp, synthetic construct
  misc_feature 1..20: note = Synthetic Construct
  source 1..20: mol_type = other DNA
ctgctgcaccaccaactact

SEQ ID NO: 41884 - DNA, 20 bp, synthetic construct
  misc_feature 1..20: note = Synthetic Construct
  source 1..20: mol_type = other DNA
acaaggtgtccccagtgtgt

SEQ ID NO: 41885 - DNA, 22 bp, synthetic construct
  misc_feature 1..22: note = Synthetic Construct
  source 1..22: mol_type = other DNA
acccggatcagtttgactgtct

SEQ ID NO: 41886 - DNA, 20 bp, synthetic construct
  misc_feature 1..20: note = Synthetic Construct
  source 1..20: mol_type = other DNA
actctgggcacatggagcaa

SEQ ID NO: 41887 - DNA, 20 bp, synthetic construct
  misc_feature 1..20: note = Synthetic Construct
  source 1..20: mol_type = other DNA
cattctggagccagggcatt

SEQ ID NO: 41888 - DNA, 25 bp, synthetic construct
  misc_feature 1..25: note = Synthetic Construct
  source 1..25: mol_type = other DNA
gctgccaaaagcaccatttggtttc

SEQ ID NO: 41889 - DNA, 22 bp, synthetic construct
  misc_feature 1..22: note = Synthetic Construct
  source 1..22: mol_type = other DNA
ggggtggtggttaggaagtgaa

SEQ ID NO: 41890 - DNA, 21 bp, synthetic construct
  misc_feature 1..21: note = Synthetic Construct
  source 1..21: mol_type = other DNA
agtccaagcccagggaaatct

SEQ ID NO: 41891 - DNA, 30 bp, synthetic construct
  misc_feature 1..30: note = Synthetic Construct
  source 1..30: mol_type = other DNA
ggtctccagataagtccaagataagaagta

SEQ ID NO: 41892 - DNA, 24 bp, synthetic construct
  misc_feature 1..24: note = Synthetic Construct
  source 1..24: mol_type = other DNA
catctccacccttgttgttactga

SEQ ID NO: 41893 - DNA, 25 bp, synthetic construct
  misc_feature 1..25: note = Synthetic Construct
  source 1..25: mol_type = other DNA
gccttctttctgggtacataagtca

SEQ ID NO: 41894 - DNA, 23 bp, synthetic construct
  misc_feature 1..23: note = Synthetic Construct
  source 1..23: mol_type = other DNA
agtggagcatggattttcacaca

SEQ ID NO: 41895 - DNA, 20 bp, synthetic construct
  misc_feature 1..20: note = Synthetic Construct
  source 1..20: mol_type = other DNA
tgcagtgggcactgatgcta

SEQ ID NO: 41896 - DNA, 22 bp, synthetic construct
  misc_feature 1..22: note = Synthetic Construct
  source 1..22: mol_type = other DNA
ggcagtccacatgtcaggatca

SEQ ID NO: 41897 - DNA, 21 bp, synthetic construct
  misc_feature 1..21: note = Synthetic Construct
  source 1..21: mol_type = other DNA
gcccagacaagctgactctgt

SEQ ID NO: 41898 - DNA, 22 bp, synthetic construct
  misc_feature 1..22: note = Synthetic Construct
  source 1..22: mol_type = other DNA
gggtcaggtgatggtgttttct

SEQ ID NO: 41899 - DNA, 23 bp, synthetic construct
  misc_feature 1..23: note = Synthetic Construct
  source 1..23: mol_type = other DNA
tgaaaccaagctcacctctcttg

SEQ ID NO: 41900 - DNA, 22 bp, synthetic construct
  misc_feature 1..22: note = Synthetic Construct
  source 1..22: mol_type = other DNA
gactgaacggtagagccctttg

SEQ ID NO: 41901 - DNA, 24 bp, synthetic construct
  misc_feature 1..24: note = Synthetic Construct
  source 1..24: mol_type = other DNA
ccaaaaccaatctggtggctcttt

SEQ ID NO: 41902 - DNA, 20 bp, synthetic construct
  misc_feature 1..20: note = Synthetic Construct
  source 1..20: mol_type = other DNA
tgtgcctggccaaggttagt

SEQ ID NO: 41903 - DNA, 24 bp, synthetic construct
  misc_feature 1..24: note = Synthetic Construct
  source 1..24: mol_type = other DNA
ctgtcagctcaaatctcaggaaga

SEQ ID NO: 41904 - DNA, 21 bp, synthetic construct
  misc_feature 1..21: note = Synthetic Construct
  source 1..21: mol_type = other DNA
tgggaggtagaacctgcaaca

SEQ ID NO: 41905 - DNA, 23 bp, synthetic construct
  misc_feature 1..23: note = Synthetic Construct
  source 1..23: mol_type = other DNA
ctggctccccattgactactttg

SEQ ID NO: 41906 - DNA, 20 bp, synthetic construct
  misc_feature 1..20: note = Synthetic Construct
  source 1..20: mol_type = other DNA
ggcaagcaggcttcatgcta

SEQ ID NO: 41907 - DNA, 22 bp, synthetic construct
  misc_feature 1..22: note = Synthetic Construct
  source 1..22: mol_type = other DNA
tggatttcccactagccactga

SEQ ID NO: 41908 - DNA, 23 bp, synthetic construct
  misc_feature 1..23: note = Synthetic Construct
  source 1..23: mol_type = other DNA
gagtcatgtgtcagctggttttg

SEQ ID NO: 41909 - DNA, 22 bp, synthetic construct
  misc_feature 1..22: note = Synthetic Construct
  source 1..22: mol_type = other DNA
cctgctgcacaatagggcaatc

SEQ ID NO: 41910 - DNA, 22 bp, synthetic construct
  misc_feature 1..22: note = Synthetic Construct
  source 1..22: mol_type = other DNA
ccccaggttgcttctgatcctt

SEQ ID NO: 41911 - DNA, 20 bp, synthetic construct
  misc_feature 1..20: note = Synthetic Construct
  source 1..20: mol_type = other DNA
tctgtgacgtgctccagttc

SEQ ID NO: 41912 - DNA, 21 bp, synthetic construct
  misc_feature 1..21: note = Synthetic Construct
  source 1..21: mol_type = other DNA
cctgccctgatgccacctatg

SEQ ID NO: 41913 - DNA, 19 bp, synthetic construct
  misc_feature 1..19: note = Synthetic Construct
  source 1..19: mol_type = other DNA
aagccaggcagggcagata

SEQ ID NO: 41914 - DNA, 27 bp, synthetic construct
  misc_feature 1..27: note = Synthetic Construct
  source 1..27: mol_type = other DNA
ctgacactggcaaattcctgaatatct

SEQ ID NO: 41915 - DNA, 20 bp, synthetic construct
  misc_feature 1..20: note = Synthetic Construct
  source 1..20: mol_type = other DNA
tccagcaggacaagcagtga

SEQ ID NO: 41916 - DNA, 25 bp, synthetic construct
  misc_feature 1..25: note = Synthetic Construct
  source 1..25: mol_type = other DNA
agaggaaaaatgaggactggttgaa

SEQ ID NO: 41917 - DNA, 24 bp, synthetic construct
  misc_feature 1..24: note = Synthetic Construct
  source 1..24: mol_type = other DNA
ggcattgtgtgaagctggatattt

SEQ ID NO: 41918 - DNA, 27 bp, synthetic construct
  misc_feature 1..27: note = Synthetic Construct
  source 1..27: mol_type = other DNA
ctataactgctctctcactgatccttt

SEQ ID NO: 41919 - DNA, 29 bp, synthetic construct
  misc_feature 1..29: note = Synthetic Construct
  source 1..29: mol_type = other DNA
gagcctaatagtcacaagctatgaacaca

SEQ ID NO: 41920 - DNA, 23 bp, synthetic construct
  misc_feature 1..23: note = Synthetic Construct
  source 1..23: mol_type = other DNA
ttggactttgtgtgcatcacttc

SEQ ID NO: 41921 - DNA, 22 bp, synthetic construct
  misc_feature 1..22: note = Synthetic Construct
  source 1..22: mol_type = other DNA
cacccacagcctctttatgagt

SEQ ID NO: 41922 - DNA, 24 bp, synthetic construct
  misc_feature 1..24: note = Synthetic Construct
  source 1..24: mol_type = other DNA
gttcagtcattggactgcttctgt

SEQ ID NO: 41923 - DNA, 25 bp, synthetic construct
  misc_feature 1..25: note = Synthetic Construct
  source 1..25: mol_type = other DNA
cactagatagtggctgcttggagta

SEQ ID NO: 41924 - DNA, 20 bp, synthetic construct
  misc_feature 1..20: note = Synthetic Construct
  source 1..20: mol_type = other DNA
ggtgagggcttgccttttca

SEQ ID NO: 41925 - DNA, 26 bp, synthetic construct
  misc_feature 1..26: note = Synthetic Construct
  source 1..26: mol_type = other DNA
cttctatgttcgccaccactttaatc

SEQ ID NO: 41926 - DNA, 25 bp, synthetic construct
  misc_feature 1..25: note = Synthetic Construct
  source 1..25: mol_type = other DNA
cctcctgtccaaaaggatgtcaaac

SEQ ID NO: 41927 - DNA, 20 bp, synthetic construct
  misc_feature 1..20: note = Synthetic Construct
  source 1..20: mol_type = other DNA
tgtcagtggcctgtgcttga

SEQ ID NO: 41928 - DNA, 22 bp, synthetic construct
  misc_feature 1..22: note = Synthetic Construct
  source 1..22: mol_type = other DNA
ggcttggccacatttgttgcat

SEQ ID NO: 41929 - DNA, 24 bp, synthetic construct
  misc_feature 1..24: note = Synthetic Construct
  source 1..24: mol_type = other DNA
tcctctttcccagtttccttctct

SEQ ID NO: 41930 - DNA, 22 bp, synthetic construct
  misc_feature 1..22: note = Synthetic Construct
  source 1..22: mol_type = other DNA
gctcagtgaattggcctcagaa

SEQ ID NO: 41931 - DNA, 23 bp, synthetic construct
  misc_feature 1..23: note = Synthetic Construct
  source 1..23: mol_type = other DNA
ccttgatggaaagggtccggttt

SEQ ID NO: 41932 - DNA, 22 bp, synthetic construct
  misc_feature 1..22: note = Synthetic Construct
  source 1..22: mol_type = other DNA
ggggaactccattaggggaaag

SEQ ID NO: 41933 - DNA, 22 bp, synthetic construct
  misc_feature 1..22: note = Synthetic Construct
  source 1..22: mol_type = other DNA
gcaggaaggagctacccacttt

SEQ ID NO: 41934 - DNA, 23 bp, synthetic construct
  misc_feature 1..23: note = Synthetic Construct
  source 1..23: mol_type = other DNA
cgttcaagcttgggaatggcata

SEQ ID NO: 41935 - DNA, 19 bp, synthetic construct
  misc_feature 1..19: note = Synthetic Construct
  source 1..19: mol_type = other DNA
agggcgcctccggtttgta

SEQ ID NO: 41936 - DNA, 21 bp, synthetic construct
  misc_feature 1..21: note = Synthetic Construct
  source 1..21: mol_type = other DNA
gtcactggacctcagcacttt

SEQ ID NO: 41937 - DNA, 24 bp, synthetic construct
  misc_feature 1..24: note = Synthetic Construct
  source 1..24: mol_type = other DNA
agtctccttccttttctccgtgta

SEQ ID NO: 41938 - DNA, 22 bp, synthetic construct
  misc_feature 1..22: note = Synthetic Construct
  source 1..22: mol_type = other DNA
tggctgaacaagagaaggcaaa

SEQ ID NO: 41939 - DNA, 23 bp, synthetic construct
  misc_feature 1..23: note = Synthetic Construct
  source 1..23: mol_type = other DNA
ccgagagacacattcctttcagt

SEQ ID NO: 41940 - DNA, 22 bp, synthetic construct
  misc_feature 1..22: note = Synthetic Construct
  source 1..22: mol_type = other DNA
gcaagcaaatggggagggacat

SEQ ID NO: 41941 - DNA, 24 bp, synthetic construct
  misc_feature 1..24: note = Synthetic Construct
  source 1..24: mol_type = other DNA
tgtaaccaacttgaccacctctct

SEQ ID NO: 41942 - DNA, 23 bp, synthetic construct
  misc_feature 1..23: note = Synthetic Construct
  source 1..23: mol_type = other DNA
gaggaagttgatgggaggtcatt

SEQ ID NO: 41943 - DNA, 24 bp, synthetic construct
  misc_feature 1..24: note = Synthetic Construct
  source 1..24: mol_type = other DNA
gaggggtatgtgactttggtcttg

SEQ ID NO: 41944 - DNA, 22 bp, synthetic construct
  misc_feature 1..22: note = Synthetic Construct
  source 1..22: mol_type = other DNA
tcaccatcatcctggcacattt

SEQ ID NO: 41945 - DNA, 20 bp, synthetic construct
  misc_feature 1..20: note = Synthetic Construct
  source 1..20: mol_type = other DNA
gcaagaccctggctcaacaa

SEQ ID NO: 41946 - DNA, 26 bp, synthetic construct
  misc_feature 1..26: note = Synthetic Construct
  source 1..26: mol_type = other DNA
ctcaaaacatctcaggtggcatgata

SEQ ID NO: 41947 - DNA, 20 bp, synthetic construct
  misc_feature 1..20: note = Synthetic Construct
  source 1..20: mol_type = other DNA
aggctccccatgctgcttta

SEQ ID NO: 41948 - DNA, 21 bp, synthetic construct
  misc_feature 1..21: note = Synthetic Construct
  source 1..21: mol_type = other DNA
gggaaaccaagggttgctgat

SEQ ID NO: 41949 - DNA, 19 bp, synthetic construct
  misc_feature 1..19: note = Synthetic Construct
  source 1..19: mol_type = other DNA
aggtgggagggaggagtga

SEQ ID NO: 41950 - DNA, 21 bp, synthetic construct
  misc_feature 1..21: note = Synthetic Construct
  source 1..21: mol_type = other DNA
tggctgacccctcctcaatca

SEQ ID NO: 41951 - DNA, 24 bp, synthetic construct
  misc_feature 1..24: note = Synthetic Construct
  source 1..24: mol_type = other DNA
ttccaaaaggggatactgcatctt

SEQ ID NO: 41952 - DNA, 22 bp, synthetic construct
  misc_feature 1..22: note = Synthetic Construct
  source 1..22: mol_type = other DNA
ggtggtggaaaaagcccaggtt

SEQ ID NO: 41953 - DNA, 21 bp, synthetic construct
  misc_feature 1..21: note = Synthetic Construct
  source 1..21: mol_type = other DNA
tacgggcctttgacgcactac

SEQ ID NO: 41954 - DNA, 22 bp, synthetic construct
  misc_feature 1..22: note = Synthetic Construct
  source 1..22: mol_type = other DNA
cctgggtatgtgtaggcagttt

SEQ ID NO: 41955 - DNA, 22 bp, synthetic construct
  misc_feature 1..22: note = Synthetic Construct
  source 1..22: mol_type = other DNA
ggctggcggcataaagaggatt

SEQ ID NO: 41956 - DNA, 22 bp, synthetic construct
  misc_feature 1..22: note = Synthetic Construct
  source 1..22: mol_type = other DNA
catggtatttcaaggcggcaat

SEQ ID NO: 41957 - DNA, 23 bp, synthetic construct
  misc_feature 1..23: note = Synthetic Construct
  source 1..23: mol_type = other DNA
gctgcagtggcacaacaaccatt

SEQ ID NO: 41958 - DNA, 26 bp, synthetic construct
  misc_feature 1..26: note = Synthetic Construct
  source 1..26: mol_type = other DNA
agctatctgggacattagaaccctat

SEQ ID NO: 41959 - DNA, 20 bp, synthetic construct
  misc_feature 1..20: note = Synthetic Construct
  source 1..20: mol_type = other DNA
tcttgcaggtagcccagtca

SEQ ID NO: 41960 - DNA, 22 bp, synthetic construct
  misc_feature 1..22: note = Synthetic Construct
  source 1..22: mol_type = other DNA
gctggggatagagctacaggat

SEQ ID NO: 41961 - DNA, 21 bp, synthetic construct
  misc_feature 1..21: note = Synthetic Construct
  source 1..21: mol_type = other DNA
ttggcagagctttctgtgtga

SEQ ID NO: 41962 - DNA, 23 bp, synthetic construct
  misc_feature 1..23: note = Synthetic Construct
  source 1..23: mol_type = other DNA
tgaagcaaggctcacattgaaac

SEQ ID NO: 41963 - DNA, 25 bp, synthetic construct
  misc_feature 1..25: note = Synthetic Construct
  source 1..25: mol_type = other DNA
ggcagaggtagaggaaagttgttag

SEQ ID NO: 41964 - DNA, 27 bp, synthetic construct
  misc_feature 1..27: note = Synthetic Construct
  source 1..27: mol_type = other DNA
gggaagaaactaccccagacttcattc

SEQ ID NO: 41965 - DNA, 19 bp, synthetic construct
  misc_feature 1..19: note = Synthetic Construct
  source 1..19: mol_type = other DNA
ccagagcctgggtgacgat

SEQ ID NO: 41966 - DNA, 20 bp, synthetic construct
  misc_feature 1..20: note = Synthetic Construct
  source 1..20: mol_type = other DNA
aggcccaagggctctttagt

SEQ ID NO: 41967 - DNA, 22 bp, synthetic construct
  misc_feature 1..22: note = Synthetic Construct
  source 1..22: mol_type = other DNA
tccctagtggtggctccagtta

SEQ ID NO: 41968 - DNA, 24 bp, synthetic construct
  misc_feature 1..24: note = Synthetic Construct
  source 1..24: mol_type = other DNA
gcataaaggtgctcagggaggaaa

SEQ ID NO: 41969 - DNA, 24 bp, synthetic construct
  misc_feature 1..24: note = Synthetic Construct
  source 1..24: mol_type = other DNA
cactggacatctggcatcttggtt

SEQ ID NO: 41970 - DNA, 21 bp, synthetic construct
  misc_feature 1..21: note = Synthetic Construct
  source 1..21: mol_type = other DNA
gccaacacaggacccttcctt

SEQ ID NO: 41971 - DNA, 24 bp, synthetic construct
  misc_feature 1..24: note = Synthetic Construct
  source 1..24: mol_type = other DNA
ccacccttactcctgtctgtgaag

SEQ ID NO: 41972 - DNA, 20 bp, synthetic construct
  misc_feature 1..20: note = Synthetic Construct
  source 1..20: mol_type = other DNA
ggcatggggtagcagcagat

SEQ ID NO: 41973 - DNA, 20 bp, synthetic construct
  misc_feature 1..20: note = Synthetic Construct
  source 1..20: mol_type = other DNA
tgggtgctctcaccctgaca

SEQ ID NO: 41974 - DNA, 25 bp, synthetic construct
  misc_feature 1..25: note = Synthetic Construct
  source 1..25: mol_type = other DNA
gggcactagcagtatgaagagactt

SEQ ID NO: 41975 - DNA, 23 bp, synthetic construct
  misc_feature 1..23: note = Synthetic Construct
  source 1..23: mol_type = other DNA
cagtactccaggaaggagctgat

SEQ ID NO: 41976 - DNA, 22 bp, synthetic construct
  misc_feature 1..22: note = Synthetic Construct
  source 1..22: mol_type = other DNA
ggctctgtgtcatcccttcctt

SEQ ID NO: 41977 - DNA, 22 bp, synthetic construct
  misc_feature 1..22: note = Synthetic Construct
  source 1..22: mol_type = other DNA
gcatcagagcgtctctccaagt

SEQ ID NO: 41978 - DNA, 22 bp, synthetic construct
  misc_feature 1..22: note = Synthetic Construct
  source 1..22: mol_type = other DNA
gtccaaggtaggtggggaaatg

SEQ ID NO: 41979 - DNA, 21 bp, synthetic construct
  misc_feature 1..21: note = Synthetic Construct
  source 1..21: mol_type = other DNA
ccagtgtccgggctcaaacat

SEQ ID NO: 41980 - DNA, 20 bp, synthetic construct
  misc_feature 1..20: note = Synthetic Construct
  source 1..20: mol_type = other DNA
tgggcaggactgaggctaca

SEQ ID NO: 41981 - DNA, 21 bp, synthetic construct
  misc_feature 1..21: note = Synthetic Construct
  source 1..21: mol_type = other DNA
atgcagggagccagccatact

SEQ ID NO: 41982 - DNA, 21 bp, synthetic construct
  misc_feature 1..21: note = Synthetic Construct
  source 1..21: mol_type = other DNA
tccccttcagcaactccaatg

SEQ ID NO: 41983 - DNA, 21 bp, synthetic construct
  misc_feature 1..21: note = Synthetic Construct
  source 1..21: mol_type = other DNA
aacttgtggggaccggtggat

SEQ ID NO: 41984 - DNA, 24 bp, synthetic construct
  misc_feature 1..24: note = Synthetic Construct
  source 1..24: mol_type = other DNA
ccggtaggtaacatccctgacatc

SEQ ID NO: 41985 - DNA, 28 bp, synthetic construct
  misc_feature 1..28: note = Synthetic Construct
  source 1..28: mol_type = other DNA
caggatgcagtagctaaatctcactaag

SEQ ID NO: 41986 - DNA, 20 bp, synthetic construct
  misc_feature 1..20: note = Synthetic Construct
  source 1..20: mol_type = other DNA
tggaccagggtgtggtcaag

SEQ ID NO: 41987 - DNA, 24 bp, synthetic construct
  misc_feature 1..24: note = Synthetic Construct
  source 1..24: mol_type = other DNA
tgatctgtgggctatgcaatttct

SEQ ID NO: 41988 - DNA, 22 bp, synthetic construct
  misc_feature 1..22: note = Synthetic Construct
  source 1..22: mol_type = other DNA
gggcctgcacctcagaaatgaa

SEQ ID NO: 41989 - DNA, 19 bp, synthetic construct
  misc_feature 1..19: note = Synthetic Construct
  source 1..19: mol_type = other DNA
tgacccaagccccgagaag

SEQ ID NO: 41990 - DNA, 20 bp, synthetic construct
  misc_feature 1..20: note = Synthetic Construct
  source 1..20: mol_type = other DNA
caagcccaagtccctgctta

SEQ ID NO: 41991 - DNA, 24 bp, synthetic construct
  misc_feature 1..24: note = Synthetic Construct
  source 1..24: mol_type = other DNA
caggaagctctcaagcctaagttc

SEQ ID NO: 41992 - DNA, 22 bp, synthetic construct
  misc_feature 1..22: note = Synthetic Construct
  source 1..22: mol_type = other DNA
gcagagctgggagcacattcat

SEQ ID NO: 41993 - DNA, 22 bp, synthetic construct
  misc_feature 1..22: note = Synthetic Construct
  source 1..22: mol_type = other DNA
gccaacagtgcaggaaaactca

SEQ ID NO: 41994 - DNA, 18 bp, synthetic construct
  misc_feature 1..18: note = Synthetic Construct
  source 1..18: mol_type = other DNA
gtgctgccctgtgagcat

SEQ ID NO: 41995 - DNA, 24 bp, synthetic construct
  misc_feature 1..24: note = Synthetic Construct
  source 1..24: mol_type = other DNA
gtgtgtaacagccttcagctcagt

SEQ ID NO: 41996 - DNA, 24 bp, synthetic construct
  misc_feature 1..24: note = Synthetic Construct
  source 1..24: mol_type = other DNA
tgggtaaatcaaggaaggaagcaa

SEQ ID NO: 41997 - DNA, 23 bp, synthetic construct
  misc_feature 1..23: note = Synthetic Construct
  source 1..23: mol_type = other DNA
ccaggattccacctaggtttgtt

SEQ ID NO: 41998 - DNA, 22 bp, synthetic construct
  misc_feature 1..22: note = Synthetic Construct
  source 1..22: mol_type = other DNA
gccagccaagtctaccatgttc

SEQ ID NO: 41999 - DNA, 22 bp, synthetic construct
  misc_feature 1..22: note = Synthetic Construct
  source 1..22: mol_type = other DNA
gagcccctgggcattacatttg

SEQ ID NO: 42000 - DNA, 22 bp, synthetic construct
  misc_feature 1..22: note = Synthetic Construct
  source 1..22: mol_type = other DNA
cctttcagtccagggtctgtgt

SEQ ID NO: 42001 - DNA, 24 bp, synthetic construct
  misc_feature 1..24: note = Synthetic Construct
  source 1..24: mol_type = other DNA
ccttgcctcttcagctcattcctt

SEQ ID NO: 42002 - DNA, 25 bp, synthetic construct
  misc_feature 1..25: note = Synthetic Construct
  source 1..25: mol_type = other DNA
tgatctattgcctttctgggcatac

SEQ ID NO: 42003 - DNA, 20 bp, synthetic construct
  misc_feature 1..20: note = Synthetic Construct
  source 1..20: mol_type = other DNA
aaagcccctcgccccaactt

SEQ ID NO: 42004 - DNA, 23 bp, synthetic construct
  misc_feature 1..23: note = Synthetic Construct
  source 1..23: mol_type = other DNA
gggcctggatgaacctagaaatg

SEQ ID NO: 42005 - DNA, 22 bp, synthetic construct
  misc_feature 1..22: note = Synthetic Construct
  source 1..22: mol_type = other DNA
acaaactgggtggggtatgagt

SEQ ID NO: 42006 - DNA, 22 bp, synthetic construct
  misc_feature 1..22: note = Synthetic Construct
  source 1..22: mol_type = other DNA
ctgttgccgggttgacttccta

SEQ ID NO: 42007 - DNA, 23 bp, synthetic construct
  misc_feature 1..23: note = Synthetic Construct
  source 1..23: mol_type = other DNA
ctgagagactgtgatggccttgt

SEQ ID NO: 42008 - DNA, 22 bp, synthetic construct
  misc_feature 1..22: note = Synthetic Construct
  source 1..22: mol_type = other DNA
ggcagtggcactagagatggaa

SEQ ID NO: 42009 - DNA, 20 bp, synthetic construct
  misc_feature 1..20: note = Synthetic Construct
  source 1..20: mol_type = other DNA
gcccaacctgccatgtccta

SEQ ID NO: 42010 - DNA, 24 bp, synthetic construct
  misc_feature 1..24: note = Synthetic Construct
  source 1..24: mol_type = other DNA
cccttcacatattcccacccttag

SEQ ID NO: 42011 - DNA, 25 bp, synthetic construct
  misc_feature 1..25: note = Synthetic Construct
  source 1..25: mol_type = other DNA
tggtcaaggttagaatgttggatgt

SEQ ID NO: 42012 - DNA, 22 bp, synthetic construct
  misc_feature 1..22: note = Synthetic Construct
  source 1..22: mol_type = other DNA
ctcctggctgaagggttaatgt

SEQ ID NO: 42013 - DNA, 21 bp, synthetic construct
  misc_feature 1..21: note = Synthetic Construct
  source 1..21: mol_type = other DNA
tgccatcagctgtacctggaa

SEQ ID NO: 42014 - DNA, 20 bp, synthetic construct
  misc_feature 1..20: note = Synthetic Construct
  source 1..20: mol_type = other DNA
cggggagtatgtggggatgt

SEQ ID NO: 42015 - DNA, 20 bp, synthetic construct
  misc_feature 1..20: note = Synthetic Construct
  source 1..20: mol_type = other DNA
ccactgtgcccggacagaaa

SEQ ID NO: 42016 - DNA, 23 bp, synthetic construct
  misc_feature 1..23: note = Synthetic Construct
  source 1..23: mol_type = other DNA
gaaggagaaagcatcagctctgt

SEQ ID NO: 42017 - DNA, 23 bp, synthetic construct
  misc_feature 1..23: note = Synthetic Construct
  source 1..23: mol_type = other DNA
ttggagtgcatttgaggaacaac

SEQ ID NO: 42018 - DNA, 22 bp, synthetic construct
  misc_feature 1..22: note = Synthetic Construct
  source 1..22: mol_type = other DNA
cggattcaccttgagcggcttt

SEQ ID NO: 42019 - DNA, 20 bp, synthetic construct
  misc_feature 1..20: note = Synthetic Construct
  source 1..20: mol_type = other DNA
ttcagggatcccagctcctt

SEQ ID NO: 42020 - DNA, 20 bp, synthetic construct
  misc_feature 1..20: note = Synthetic Construct
  source 1..20: mol_type = other DNA
gctccccttccagctcttgt

SEQ ID NO: 42021 - DNA, 20 bp, synthetic construct
  misc_feature 1..20: note = Synthetic Construct
  source 1..20: mol_type = other DNA
ggagctggggtttggggaaa

SEQ ID NO: 42022 - DNA, 24 bp, synthetic construct
  misc_feature 1..24: note = Synthetic Construct
  source 1..24: mol_type = other DNA
ggcaactcctgtactaccgtcctt

SEQ ID NO: 42023 - DNA, 21 bp, synthetic construct
  misc_feature 1..21: note = Synthetic Construct
  source 1..21: mol_type = other DNA
tgcctcctgccgctatcagta

SEQ ID NO: 42024 - DNA, 25 bp, synthetic construct
  misc_feature 1..25: note = Synthetic Construct
  source 1..25: mol_type = other DNA
gacttgcgatatccgggatcttaac

SEQ ID NO: 42025 - DNA, 23 bp, synthetic construct
  misc_feature 1..23: note = Synthetic Construct
  source 1..23: mol_type = other DNA
atccagtagctgaaggtctctga

SEQ ID NO: 42026 - DNA, 20 bp, synthetic construct
  misc_feature 1..20: note = Synthetic Construct
  source 1..20: mol_type = other DNA
gcaaactgcctgtcctgctt

SEQ ID NO: 42027 - DNA, 23 bp, synthetic construct
  misc_feature 1..23: note = Synthetic Construct
  source 1..23: mol_type = other DNA
ggtaggagctggttccaacatga

SEQ ID NO: 42028 - DNA, 20 bp, synthetic construct
  misc_feature 1..20: note = Synthetic Construct
  source 1..20: mol_type = other DNA
actctccgaggtgggcaaag

SEQ ID NO: 42029 - DNA, 22 bp, synthetic construct
  misc_feature 1..22: note = Synthetic Construct
  source 1..22: mol_type = other DNA
acagcccttatggaggccttag

SEQ ID NO: 42030 - DNA, 22 bp, synthetic construct
  misc_feature 1..22: note = Synthetic Construct
  source 1..22: mol_type = other DNA
agctggtctcagggaggaacaa

SEQ ID NO: 42031 - DNA, 21 bp, synthetic construct
  misc_feature 1..21: note = Synthetic Construct
  source 1..21: mol_type = other DNA
aacccgacctgaggccctgaa

SEQ ID NO: 42032 - DNA, 25 bp, synthetic construct
  misc_feature 1..25: note = Synthetic Construct
  source 1..25: mol_type = other DNA
tgagggtttaaggagataggggtta

SEQ ID NO: 42033 - DNA, 22 bp, synthetic construct
  misc_feature 1..22: note = Synthetic Construct
  source 1..22: mol_type = other DNA
ggccaaaccctgtgactcttct

SEQ ID NO: 42034 - DNA, 23 bp, synthetic construct
  misc_feature 1..23: note = Synthetic Construct
  source 1..23: mol_type = other DNA
ggctcaagtcagcagtgatggaa

SEQ ID NO: 42035 - DNA, 22 bp, synthetic construct
  misc_feature 1..22: note = Synthetic Construct
  source 1..22: mol_type = other DNA
gggttcgtccaacttcctgtag

SEQ ID NO: 42036 - DNA, 23 bp, synthetic construct
  misc_feature 1..23: note = Synthetic Construct
  source 1..23: mol_type = other DNA
tgcctttcctgaccagataccat

SEQ ID NO: 42037 - DNA, 23 bp, synthetic construct
  misc_feature 1..23: note = Synthetic Construct
  source 1..23: mol_type = other DNA
ggtcccctcctaggtgtcgttta

SEQ ID NO: 42038 - DNA, 21 bp, synthetic construct
  misc_feature 1..21: note = Synthetic Construct
  source 1..21: mol_type = other DNA
cccaactgcctgtggttggta

SEQ ID NO: 42039 - DNA, 20 bp, synthetic construct
  misc_feature 1..20: note = Synthetic Construct
  source 1..20: mol_type = other DNA
gcgcttgctgctggttaaga

SEQ ID NO: 42040 - DNA, 25 bp, synthetic construct
  misc_feature 1..25: note = Synthetic Construct
  source 1..25: mol_type = other DNA
caggttctagaaagtgtctgcttct

SEQ ID NO: 42041 - DNA, 22 bp, synthetic construct
  misc_feature 1..22: note = Synthetic Construct
  source 1..22: mol_type = other DNA
gccatgccacaggcaagtaagt

SEQ ID NO: 42042 - DNA, 20 bp, synthetic construct
  misc_feature 1..20: note = Synthetic Construct
  source 1..20: mol_type = other DNA
agaggctgcctgggctggaa

SEQ ID NO: 42043 - DNA, 20 bp, synthetic construct
  misc_feature 1..20: note = Synthetic Construct
  source 1..20: mol_type = other DNA
tgggctgctttccccagttg

SEQ ID NO: 42044 - DNA, 26 bp, synthetic construct
  misc_feature 1..26: note = Synthetic Construct
  source 1..26: mol_type = other DNA
tggagaagaatacaagtgaggctttg

SEQ ID NO: 42045 - DNA, 28 bp, synthetic construct
  misc_feature 1..28: note = Synthetic Construct
  source 1..28: mol_type = other DNA
ctggggaattcaaaacaggagagaaaag

SEQ ID NO: 42046 - DNA, 22 bp, synthetic construct
  misc_feature 1..22: note = Synthetic Construct
  source 1..22: mol_type = other DNA
gggctctatcgctctttggtaa

SEQ ID NO: 42047 - DNA, 24 bp, synthetic construct
  misc_feature 1..24: note = Synthetic Construct
  source 1..24: mol_type = other DNA
gtgagctactaagagccaccaact

SEQ ID NO: 42048 - DNA, 20 bp, synthetic construct
  misc_feature 1..20: note = Synthetic Construct
  source 1..20: mol_type = other DNA
agcagcagaaacccctcttg

SEQ ID NO: 42049 - DNA, 22 bp, synthetic construct
  misc_feature 1..22: note = Synthetic Construct
  source 1..22: mol_type = other DNA
cccaatgtcttcccgtcacagt

SEQ ID NO: 42050 - DNA, 21 bp, synthetic construct
  misc_feature 1..21: note = Synthetic Construct
  source 1..21: mol_type = other DNA
gttgcagcttggggagttaga

SEQ ID NO: 42051 - DNA, 23 bp, synthetic construct
  misc_feature 1..23: note = Synthetic Construct
  source 1..23: mol_type = other DNA
atgtggtcatcgctaaacactct

SEQ ID NO: 42052 - DNA, 22 bp, synthetic construct
  misc_feature 1..22: note = Synthetic Construct
  source 1..22: mol_type = other DNA
cgagcaaggggctactgatgaa

SEQ ID NO: 42053 - DNA, 22 bp, synthetic construct
  misc_feature 1..22: note = Synthetic Construct
  source 1..22: mol_type = other DNA
gggagaatatttggccctgtga

SEQ ID NO: 42054 - DNA, 18 bp, synthetic construct
  misc_feature 1..18: note = Synthetic Construct
  source 1..18: mol_type = other DNA
tggtgaccgtgcgaggaa

SEQ ID NO: 42055 - DNA, 20 bp, synthetic construct
  misc_feature 1..20: note = Synthetic Construct
  source 1..20: mol_type = other DNA
ctggcagtctgggagagtca

SEQ ID NO: 42056 - DNA, 22 bp, synthetic construct
  misc_feature 1..22: note = Synthetic Construct
  source 1..22: mol_type = other DNA
ccgagctacacgaggagatgaa

SEQ ID NO: 42057 - DNA, 25 bp, synthetic construct
  misc_feature 1..25: note = Synthetic Construct
  source 1..25: mol_type = other DNA
cccactccaagaccttcaagaggaa

SEQ ID NO: 42058 - DNA, 22 bp, synthetic construct
  misc_feature 1..22: note = Synthetic Construct
  source 1..22: mol_type = other DNA
gcaccttggcaggactcagaat

SEQ ID NO: 42059 - DNA, 26 bp, synthetic construct
  misc_feature 1..26: note = Synthetic Construct
  source 1..26: mol_type = other DNA
ccccttagaaaaatgaggtggtgaga

SEQ ID NO: 42060 - DNA, 20 bp, synthetic construct
  misc_feature 1..20: note = Synthetic Construct
  source 1..20: mol_type = other DNA
gcttcaacagcccagtgctt

SEQ ID NO: 42061 - DNA, 22 bp, synthetic construct
  misc_feature 1..22: note = Synthetic Construct
  source 1..22: mol_type = other DNA
aacttggtcaggtggggttttt

SEQ ID NO: 42062 - DNA, 20 bp, synthetic construct
  misc_feature 1..20: note = Synthetic Construct
  source 1..20: mol_type = other DNA
tcggggcttctgctgtcaaa

SEQ ID NO: 42063 - DNA, 23 bp, synthetic construct
  misc_feature 1..23: note = Synthetic Construct
  source 1..23: mol_type = other DNA
cagtgttgccagatagagagctt

SEQ ID NO: 42064 - DNA, 22 bp, synthetic construct
  misc_feature 1..22: note = Synthetic Construct
  source 1..22: mol_type = other DNA
ccagggttcacaagacaaggtt

SEQ ID NO: 42065 - DNA, 22 bp, synthetic construct
  misc_feature 1..22: note = Synthetic Construct
  source 1..22: mol_type = other DNA
aacaagtgtggcagcataggta

SEQ ID NO: 42066 - DNA, 22 bp, synthetic construct
  misc_feature 1..22: note = Synthetic Construct
  source 1..22: mol_type = other DNA
aggtgacccttccactcacatc

SEQ ID NO: 42067 - DNA, 19 bp, synthetic construct
  misc_feature 1..19: note = Synthetic Construct
  source 1..19: mol_type = other DNA
ttgctagccacgggacaca

SEQ ID NO: 42068 - DNA, 20 bp, synthetic construct
  misc_feature 1..20: note = Synthetic Construct
  source 1..20: mol_type = other DNA
ttgccccatcctgacacagt

SEQ ID NO: 42069 - DNA, 23 bp, synthetic construct
  misc_feature 1..23: note = Synthetic Construct
  source 1..23: mol_type = other DNA
cagcaaacctacctgcgttgaag

SEQ ID NO: 42070 - DNA, 26 bp, synthetic construct
  misc_feature 1..26: note = Synthetic Construct
  source 1..26: mol_type = other DNA
ggatgagctccttgtagttcttgttc

SEQ ID NO: 42071 - DNA, 24 bp, synthetic construct
  misc_feature 1..24: note = Synthetic Construct
  source 1..24: mol_type = other DNA
gccatcaatcccatctgcttcaca

SEQ ID NO: 42072 - DNA, 22 bp, synthetic construct
  misc_feature 1..22: note = Synthetic Construct
  source 1..22: mol_type = other DNA
aggaacccaccgatgcttcaac

SEQ ID NO: 42073 - DNA, 20 bp, synthetic construct
  misc_feature 1..20: note = Synthetic Construct
  source 1..20: mol_type = other DNA
atgtctcgcaggctcctgta

SEQ ID NO: 42074 - DNA, 22 bp, synthetic construct
  misc_feature 1..22: note = Synthetic Construct
  source 1..22: mol_type = other DNA
gcacccatctcattgccactgt

SEQ ID NO: 42075 - DNA, 25 bp, synthetic construct
  misc_feature 1..25: note = Synthetic Construct
  source 1..25: mol_type = other DNA
attggggtgaatcagaactgtatgt

SEQ ID NO: 42076 - DNA, 20 bp, synthetic construct
  misc_feature 1..20: note = Synthetic Construct
  source 1..20: mol_type = other DNA
gctacccagggagcccctta

SEQ ID NO: 42077 - DNA, 25 bp, synthetic construct
  misc_feature 1..25: note = Synthetic Construct
  source 1..25: mol_type = other DNA
cctctattccaagcccaggcaaaag

SEQ ID NO: 42078 - DNA, 30 bp, synthetic construct
  misc_feature 1..30: note = Synthetic Construct
  source 1..30: mol_type = other DNA
gggttttaacgaaagtaagggctaaagtct

SEQ ID NO: 42079 - DNA, 23 bp, synthetic construct
  misc_feature 1..23: note = Synthetic Construct
  source 1..23: mol_type = other DNA
gagtaaggaggagtgcctcatgt

SEQ ID NO: 42080 - DNA, 23 bp, synthetic construct
  misc_feature 1..23: note = Synthetic Construct
  source 1..23: mol_type = other DNA
gctcatggccatcctctctggta

SEQ ID NO: 42081 - DNA, 24 bp, synthetic construct
  misc_feature 1..24: note = Synthetic Construct
  source 1..24: mol_type = other DNA
cacagaggtgggacctaccattac

SEQ ID NO: 42082 - DNA, 20 bp, synthetic construct
  misc_feature 1..20: note = Synthetic Construct
  source 1..20: mol_type = other DNA
attcagtgcccagcatggtt

SEQ ID NO: 42083 - DNA, 21 bp, synthetic construct
  misc_feature 1..21: note = Synthetic Construct
  source 1..21: mol_type = other DNA
gcaagttcaggccaacacgaa

SEQ ID NO: 42084 - DNA, 23 bp, synthetic construct
  misc_feature 1..23: note = Synthetic Construct
  source 1..23: mol_type = other DNA
tgtgttccaatacctgcctgaat

SEQ ID NO: 42085 - DNA, 26 bp, synthetic construct
  misc_feature 1..26: note = Synthetic Construct
  source 1..26: mol_type = other DNA
ggtgccagtggtgataaagtggtcta

SEQ ID NO: 42086 - DNA, 24 bp, synthetic construct
  misc_feature 1..24: note = Synthetic Construct
  source 1..24: mol_type = other DNA
ggggtagtcaaggttgtctaggaa

SEQ ID NO: 42087 - DNA, 27 bp, synthetic construct
  misc_feature 1..27: note = Synthetic Construct
  source 1..27: mol_type = other DNA
ggaagcttgaaacgaattgtgcagttt

SEQ ID NO: 42088 - DNA, 18 bp, synthetic construct
  misc_feature 1..18: note = Synthetic Construct
  source 1..18: mol_type = other DNA
tgtgcacgcaagctcctt

SEQ ID NO: 42089 - DNA, 19 bp, synthetic construct
  misc_feature 1..19: note = Synthetic Construct
  source 1..19: mol_type = other DNA
aggctggggctctgtcctt

SEQ ID NO: 42090 - DNA, 24 bp, synthetic construct
  misc_feature 1..24: note = Synthetic Construct
  source 1..24: mol_type = other DNA
cctcaggattggcttctgggaaaa

SEQ ID NO: 42091 - DNA, 24 bp, synthetic construct
  misc_feature 1..24: note = Synthetic Construct
  source 1..24: mol_type = other DNA
ggtccatacccaatggccaggatt

SEQ ID NO: 42092 - DNA, 22 bp, synthetic construct
  misc_feature 1..22: note = Synthetic Construct
  source 1..22: mol_type = other DNA
aggggaaggagaatggccttag

SEQ ID NO: 42093 - DNA, 24 bp, synthetic construct
  misc_feature 1..24: note = Synthetic Construct
  source 1..24: mol_type = other DNA
ccctaaatggttgctcctgaaact

SEQ ID NO: 42094 - DNA, 22 bp, synthetic construct
  misc_feature 1..22: note = Synthetic Construct
  source 1..22: mol_type = other DNA
ccagcgtcatcttccagtgtca

SEQ ID NO: 42095 - DNA, 22 bp, synthetic construct
  misc_feature 1..22: note = Synthetic Construct
  source 1..22: mol_type = other DNA
gtcactctccggctttaacact

SEQ ID NO: 42096 - DNA, 23 bp, synthetic construct
  misc_feature 1..23: note = Synthetic Construct
  source 1..23: mol_type = other DNA
ggaagtgtctactgaccgcaaag

SEQ ID NO: 42097 - DNA, 20 bp, synthetic construct
  misc_feature 1..20: note = Synthetic Construct
  source 1..20: mol_type = other DNA
cagtgtgcaactgggtgact

SEQ ID NO: 42098 - DNA, 21 bp, synthetic construct
  misc_feature 1..21: note = Synthetic Construct
  source 1..21: mol_type = other DNA
ctgtgtgctgtctcagtgcaa

SEQ ID NO: 42099 - DNA, 18 bp, synthetic construct
  misc_feature 1..18: note = Synthetic Construct
  source 1..18: mol_type = other DNA
acccactgccccacttca

SEQ ID NO: 42100 - DNA, 23 bp, synthetic construct
  misc_feature 1..23: note = Synthetic Construct
  source 1..23: mol_type = other DNA
ctgactcttggcacagcctttag

SEQ ID NO: 42101 - DNA, 30 bp, synthetic construct
  misc_feature 1..30: note = Synthetic Construct
  source 1..30: mol_type = other DNA
ctcaaactgtctaagtccgatgtaatggaa

SEQ ID NO: 42102 - DNA, 21 bp, synthetic construct
  misc_feature 1..21: note = Synthetic Construct
  source 1..21: mol_type = other DNA
actcaccgatgtgcagagaga

SEQ ID NO: 42103 - DNA, 22 bp, synthetic construct
  misc_feature 1..22: note = Synthetic Construct
  source 1..22: mol_type = other DNA
cactccaaaagcagtggcatgt

SEQ ID NO: 42104 - DNA, 20 bp, synthetic construct
  misc_feature 1..20: note = Synthetic Construct
  source 1..20: mol_type = other DNA
acaggctttggcagcagact

SEQ ID NO: 42105 - DNA, 24 bp, synthetic construct
  misc_feature 1..24: note = Synthetic Construct
  source 1..24: mol_type = other DNA
ccaaaagaggcacgctgagagaag

SEQ ID NO: 42106 - DNA, 22 bp, synthetic construct
  misc_feature 1..22: note = Synthetic Construct
  source 1..22: mol_type = other DNA
atactggaccagaggctgatct

SEQ ID NO: 42107 - DNA, 25 bp, synthetic construct
  misc_feature 1..25: note = Synthetic Construct
  source 1..25: mol_type = other DNA
gctgttggtattccttggggtgaag

SEQ ID NO: 42108 - DNA, 22 bp, synthetic construct
  misc_feature 1..22: note = Synthetic Construct
  source 1..22: mol_type = other DNA
gcatagtccaccagaggcatgt

SEQ ID NO: 42109 - DNA, 20 bp, synthetic construct
  misc_feature 1..20: note = Synthetic Construct
  source 1..20: mol_type = other DNA
ccgctttctgacaccaccaa

SEQ ID NO: 42110 - DNA, 20 bp, synthetic construct
  misc_feature 1..20: note = Synthetic Construct
  source 1..20: mol_type = other DNA
ggcaggacacgtcgtaaaca

SEQ ID NO: 42111 - DNA, 22 bp, synthetic construct
  misc_feature 1..22: note = Synthetic Construct
  source 1..22: mol_type = other DNA
ccctcctgccccatctctactt

SEQ ID NO: 42112 - DNA, 20 bp, synthetic construct
  misc_feature 1..20: note = Synthetic Construct
  source 1..20: mol_type = other DNA
tctccgctcagcttctgtca

SEQ ID NO: 42113 - DNA, 22 bp, synthetic construct
  misc_feature 1..22: note = Synthetic Construct
  source 1..22: mol_type = other DNA
gcacctgtgatgctgtgtggtt

SEQ ID NO: 42114 - DNA, 20 bp, synthetic construct
  misc_feature 1..20: note = Synthetic Construct
  source 1..20: mol_type = other DNA
tgtggcatgaaggcaacaga

SEQ ID NO: 42115 - DNA, 22 bp, synthetic construct
  misc_feature 1..22: note = Synthetic Construct
  source 1..22: mol_type = other DNA
ctgctacaacctccctcccaaa

SEQ ID NO: 42116 - DNA, 22 bp, synthetic construct
  misc_feature 1..22: note = Synthetic Construct
  source 1..22: mol_type = other DNA
actaaagcctttggggcagaag

SEQ ID NO: 42117 - DNA, 24 bp, synthetic construct
  misc_feature 1..24: note = Synthetic Construct
  source 1..24: mol_type = other DNA
gctcttggcacatgccatatgatt

SEQ ID NO: 42118 - DNA, 22 bp, synthetic construct
  misc_feature 1..22: note = Synthetic Construct
  source 1..22: mol_type = other DNA
aacctgagacctgtccctgttg

SEQ ID NO: 42119 - DNA, 22 bp, synthetic construct
  misc_feature 1..22: note = Synthetic Construct
  source 1..22: mol_type = other DNA
gcctagtgtctgtctcccaatg

SEQ ID NO: 42120 - DNA, 25 bp, synthetic construct
  misc_feature 1..25: note = Synthetic Construct
  source 1..25: mol_type = other DNA
ggttggatagttggcaacccatgtt

SEQ ID NO: 42121 - DNA, 25 bp, synthetic construct
  misc_feature 1..25: note = Synthetic Construct
  source 1..25: mol_type = other DNA
cctcagtcagttaagagctggcaaa

SEQ ID NO: 42122 - DNA, 19 bp, synthetic construct
  misc_feature 1..19: note = Synthetic Construct
  source 1..19: mol_type = other DNA
atgttgggcctggctttgt

SEQ ID NO: 42123 - DNA, 21 bp, synthetic construct
  misc_feature 1..21: note = Synthetic Construct
  source 1..21: mol_type = other DNA
ttccatcccagggcccctttt

SEQ ID NO: 42124 - DNA, 23 bp, synthetic construct
  misc_feature 1..23: note = Synthetic Construct
  source 1..23: mol_type = other DNA
agaccttatattcgctgctgcat

SEQ ID NO: 42125 - DNA, 27 bp, synthetic construct
  misc_feature 1..27: note = Synthetic Construct
  source 1..27: mol_type = other DNA
ggcaagttctaggaagacagttattct

SEQ ID NO: 42126 - DNA, 21 bp, synthetic construct
  misc_feature 1..21: note = Synthetic Construct
  source 1..21: mol_type = other DNA
agcctcactggtgtgtgtttc

SEQ ID NO: 42127 - DNA, 21 bp, synthetic construct
  misc_feature 1..21: note = Synthetic Construct
  source 1..21: mol_type = other DNA
gtgtctgcagcttgtgaccat

SEQ ID NO: 42128 - DNA, 20 bp, synthetic construct
  misc_feature 1..20: note = Synthetic Construct
  source 1..20: mol_type = other DNA
actagaacacggggcagtga

SEQ ID NO: 42129 - DNA, 24 bp, synthetic construct
  misc_feature 1..24: note = Synthetic Construct
  source 1..24: mol_type = other DNA
ctcaattcagctagaggcacacaa

SEQ ID NO: 42130 - DNA, 23 bp, synthetic construct
  misc_feature 1..23: note = Synthetic Construct
  source 1..23: mol_type = other DNA
gccttacagggtagcccacctta

SEQ ID NO: 42131 - DNA, 20 bp, synthetic construct
  misc_feature 1..20: note = Synthetic Construct
  source 1..20: mol_type = other DNA
gccgggccaatgttcaaatg

SEQ ID NO: 42132 - DNA, 22 bp, synthetic construct
  misc_feature 1..22: note = Synthetic Construct
  source 1..22: mol_type = other DNA
gcttcttggaggaggttgcata

SEQ ID NO: 42133 - DNA, 23 bp, synthetic construct
  misc_feature 1..23: note = Synthetic Construct
  source 1..23: mol_type = other DNA
gctgaggccccttttctccaaag

SEQ ID NO: 42134 - DNA, 25 bp, synthetic construct
  misc_feature 1..25: note = Synthetic Construct
  source 1..25: mol_type = other DNA
ccactcctaggggtagatctagttg

SEQ ID NO: 42135 - DNA, 20 bp, synthetic construct
  misc_feature 1..20: note = Synthetic Construct
  source 1..20: mol_type = other DNA
gcaatccaggctgggtcctt

SEQ ID NO: 42136 - DNA, 25 bp, synthetic construct
  misc_feature 1..25: note = Synthetic Construct
  source 1..25: mol_type = other DNA
ctcccatcctctcatcttacctgtt

SEQ ID NO: 42137 - DNA, 24 bp, synthetic construct
  misc_feature 1..24: note = Synthetic Construct
  source 1..24: mol_type = other DNA
ggtttatacctgcacatgccaatg

SEQ ID NO: 42138 - DNA, 27 bp, synthetic construct
  misc_feature 1..27: note = Synthetic Construct
  source 1..27: mol_type = other DNA
ccctgaacaggcataccaacatataca

SEQ ID NO: 42139 - DNA, 29 bp, synthetic construct
  misc_feature 1..29: note = Synthetic Construct
  source 1..29: mol_type = other DNA
ccccatagtttcctgcttccatctttgaa

SEQ ID NO: 42140 - DNA, 22 bp, synthetic construct
  misc_feature 1..22: note = Synthetic Construct
  source 1..22: mol_type = other DNA
ccctgtggagcgactctactaa

SEQ ID NO: 42141 - DNA, 21 bp, synthetic construct
  misc_feature 1..21: note = Synthetic Construct
  source 1..21: mol_type = other DNA
aggcaaggagctgggaaggtt

SEQ ID NO: 42142 - DNA, 23 bp, synthetic construct
  misc_feature 1..23: note = Synthetic Construct
  source 1..23: mol_type = other DNA
gtggtcagttcttatggcagcta

SEQ ID NO: 42143 - DNA, 23 bp, synthetic construct
  misc_feature 1..23: note = Synthetic Construct
  source 1..23: mol_type = other DNA
ggacggtccaggagatgtacctt

SEQ ID NO: 42144 - DNA, 24 bp, synthetic construct
  misc_feature 1..24: note = Synthetic Construct
  source 1..24: mol_type = other DNA
gggacaatggggtaggatggagat

SEQ ID NO: 42145 - DNA, 20 bp, synthetic construct
  misc_feature 1..20: note = Synthetic Construct
  source 1..20: mol_type = other DNA
tctgtgtgcccgtcctcaat

SEQ ID NO: 42146 - DNA, 22 bp, synthetic construct
  misc_feature 1..22: note = Synthetic Construct
  source 1..22: mol_type = other DNA
gagtgccagatccaagccaatg

SEQ ID NO: 42147 - DNA, 25 bp, synthetic construct
  misc_feature 1..25: note = Synthetic Construct
  source 1..25: mol_type = other DNA
cggtaagagctggagaagccatctt

SEQ ID NO: 42148 - DNA, 28 bp, synthetic construct
  misc_feature 1..28: note = Synthetic Construct
  source 1..28: mol_type = other DNA
ccagccatagatcaccatatccccttag

SEQ ID NO: 42149 - DNA, 19 bp, synthetic construct
  misc_feature 1..19: note = Synthetic Construct
  source 1..19: mol_type = other DNA
ggtgggagggacaggcaaa

SEQ ID NO: 42150 - DNA, 20 bp, synthetic construct
  misc_feature 1..20: note = Synthetic Construct
  source 1..20: mol_type = other DNA
gctacaggctgactgtgcaa

SEQ ID NO: 42151 - DNA, 21 bp, synthetic construct
  misc_feature 1..21: note = Synthetic Construct
  source 1..21: mol_type = other DNA
aggtggtgagtggtggggttt

SEQ ID NO: 42152 - DNA, 25 bp, synthetic construct
  misc_feature 1..25: note = Synthetic Construct
  source 1..25: mol_type = other DNA
ggctttattcattcgcaaccctgtt

SEQ ID NO: 42153 - DNA, 23 bp, synthetic construct
  misc_feature 1..23: note = Synthetic Construct
  source 1..23: mol_type = other DNA
ggcagtgggtagaggagacttca

SEQ ID NO: 42154 - DNA, 24 bp, synthetic construct
  misc_feature 1..24: note = Synthetic Construct
  source 1..24: mol_type = other DNA
cctcggccagatttctactttttc

SEQ ID NO: 42155 - DNA, 23 bp, synthetic construct
  misc_feature 1..23: note = Synthetic Construct
  source 1..23: mol_type = other DNA
ccatcacagcctaaccacggaat

SEQ ID NO: 42156 - DNA, 25 bp, synthetic construct
  misc_feature 1..25: note = Synthetic Construct
  source 1..25: mol_type = other DNA
agttcaagttttctgacctggctat

SEQ ID NO: 42157 - DNA, 22 bp, synthetic construct
  misc_feature 1..22: note = Synthetic Construct
  source 1..22: mol_type = other DNA
tggaagagggaggcaactctgt

SEQ ID NO: 42158 - DNA, 20 bp, synthetic construct
  misc_feature 1..20: note = Synthetic Construct
  source 1..20: mol_type = other DNA
ggccactgcttgatgcaaag

SEQ ID NO: 42159 - DNA, 21 bp, synthetic construct
  misc_feature 1..21: note = Synthetic Construct
  source 1..21: mol_type = other DNA
acaacaagcccaatgccgtta

SEQ ID NO: 42160 - DNA, 24 bp, synthetic construct
  misc_feature 1..24: note = Synthetic Construct
  source 1..24: mol_type = other DNA
cacatgaggtgtttctctcccaat

SEQ ID NO: 42161 - DNA, 26 bp, synthetic construct
  misc_feature 1..26: note = Synthetic Construct
  source 1..26: mol_type = other DNA
cctcatggcctgaaacaaaccctaac

SEQ ID NO: 42162 - DNA, 24 bp, synthetic construct
  misc_feature 1..24: note = Synthetic Construct
  source 1..24: mol_type = other DNA
caaaggtttaggggcttcccatag

SEQ ID NO: 42163 - DNA, 26 bp, synthetic construct
  misc_feature 1..26: note = Synthetic Construct
  source 1..26: mol_type = other DNA
tgctacattcaaaggggagtacaaag

SEQ ID NO: 42164 - DNA, 26 bp, synthetic construct
  misc_feature 1..26: note = Synthetic Construct
  source 1..26: mol_type = other DNA
gtcattacatctgacccactctcagt

SEQ ID NO: 42165 - DNA, 25 bp, synthetic construct
  misc_feature 1..25: note = Synthetic Construct
  source 1..25: mol_type = other DNA
caatgctcagtctctgtcttgaaac

SEQ ID NO: 42166 - DNA, 22 bp, synthetic construct
  misc_feature 1..22: note = Synthetic Construct
  source 1..22: mol_type = other DNA
ggcacagagtgtgagacccaat

SEQ ID NO: 42167 - DNA, 25 bp, synthetic construct
  misc_feature 1..25: note = Synthetic Construct
  source 1..25: mol_type = other DNA
gctctcccaagaattatctcaccaa

SEQ ID NO: 42168 - DNA, 22 bp, synthetic construct
  misc_feature 1..22: note = Synthetic Construct
  source 1..22: mol_type = other DNA
gggcctaagctccatccaatct

SEQ ID NO: 42169 - DNA, 25 bp, synthetic construct
  misc_feature 1..25: note = Synthetic Construct
  source 1..25: mol_type = other DNA
ccatcacattgctcaaactgctttc

SEQ ID NO: 42170 - DNA, 21 bp, synthetic construct
  misc_feature 1..21: note = Synthetic Construct
  source 1..21: mol_type = other DNA
aggacgtgcattgggaacatc

SEQ ID NO: 42171 - DNA, 22 bp, synthetic construct
  misc_feature 1..22: note = Synthetic Construct
  source 1..22: mol_type = other DNA
ccaagcaagggctccaggttta

SEQ ID NO: 42172 - DNA, 25 bp, synthetic construct
  misc_feature 1..25: note = Synthetic Construct
  source 1..25: mol_type = other DNA
ctggatcataaaacgctacgtgact

SEQ ID NO: 42173 - DNA, 27 bp, synthetic construct
  misc_feature 1..27: note = Synthetic Construct
  source 1..27: mol_type = other DNA
ggctttttccatctaatcaccaagatg

SEQ ID NO: 42174 - DNA, 23 bp, synthetic construct
  misc_feature 1..23: note = Synthetic Construct
  source 1..23: mol_type = other DNA
agctacacaaaaagcctgggtaa

SEQ ID NO: 42175 - DNA, 22 bp, synthetic construct
  misc_feature 1..22: note = Synthetic Construct
  source 1..22: mol_type = other DNA
cctgatccactggtggtcaact

SEQ ID NO: 42176 - DNA, 24 bp, synthetic construct
  misc_feature 1..24: note = Synthetic Construct
  source 1..24: mol_type = other DNA
gattaaaatgcgctgactccaagt

SEQ ID NO: 42177 - DNA, 19 bp, synthetic construct
  misc_feature 1..19: note = Synthetic Construct
  source 1..19: mol_type = other DNA
ccgtggtgggtgtgctgtt

SEQ ID NO: 42178 - DNA, 22 bp, synthetic construct
  misc_feature 1..22: note = Synthetic Construct
  source 1..22: mol_type = other DNA
ggcttagagaggggaagcaact

SEQ ID NO: 42179 - DNA, 25 bp, synthetic construct
  misc_feature 1..25: note = Synthetic Construct
  source 1..25: mol_type = other DNA
agaaggttctaggcagaaacagtag

SEQ ID NO: 42180 - DNA, 19 bp, synthetic construct
  misc_feature 1..19: note = Synthetic Construct
  source 1..19: mol_type = other DNA
cctcctggcctgagccaaa

SEQ ID NO: 42181 - DNA, 26 bp, synthetic construct
  misc_feature 1..26: note = Synthetic Construct
  source 1..26: mol_type = other DNA
acaattacagcagccatctaggttag

SEQ ID NO: 42182 - DNA, 20 bp, synthetic construct
  misc_feature 1..20: note = Synthetic Construct
  source 1..20: mol_type = other DNA
cccaaaggcagggatccaaa

SEQ ID NO: 42183 - DNA, 20 bp, synthetic construct
  misc_feature 1..20: note = Synthetic Construct
  source 1..20: mol_type = other DNA
ttaccctggcacacctgttg

SEQ ID NO: 42184 - DNA, 25 bp, synthetic construct
  misc_feature 1..25: note = Synthetic Construct
  source 1..25: mol_type = other DNA
gggaaatccaggtaggcttcacaga

SEQ ID NO: 42185 - DNA, 20 bp, synthetic construct
  misc_feature 1..20: note = Synthetic Construct
  source 1..20: mol_type = other DNA
acaggcacacaccactgcta

SEQ ID NO: 42186 - DNA, 23 bp, synthetic construct
  misc_feature 1..23: note = Synthetic Construct
  source 1..23: mol_type = other DNA
gcttggtcctggatgtagcagat

SEQ ID NO: 42187 - DNA, 23 bp, synthetic construct
  misc_feature 1..23: note = Synthetic Construct
  source 1..23: mol_type = other DNA
cctcaatctcccactggaaggaa

SEQ ID NO: 42188 - DNA, 22 bp, synthetic construct
  misc_feature 1..22: note = Synthetic Construct
  source 1..22: mol_type = other DNA
tgatgtggctagctctctcgta

SEQ ID NO: 42189 - DNA, 23 bp, synthetic construct
  misc_feature 1..23: note = Synthetic Construct
  source 1..23: mol_type = other DNA
gcctctcacgtaccattcacaca

SEQ ID NO: 42190 - DNA, 22 bp, synthetic construct
  misc_feature 1..22: note = Synthetic Construct
  source 1..22: mol_type = other DNA
gtgggccaacttgaggtctgat

SEQ ID NO: 42191 - DNA, 23 bp, synthetic construct
  misc_feature 1..23: note = Synthetic Construct
  source 1..23: mol_type = other DNA
cgcttgaaaacacgtccactaaa

SEQ ID NO: 42192 - DNA, 26 bp, synthetic construct
  misc_feature 1..26: note = Synthetic Construct
  source 1..26: mol_type = other DNA
cttactactagtgtccagaggcaaag

SEQ ID NO: 42193 - DNA, 26 bp, synthetic construct
  misc_feature 1..26: note = Synthetic Construct
  source 1..26: mol_type = other DNA
ggcctcttggccatagataacctgat

SEQ ID NO: 42194 - DNA, 25 bp, synthetic construct
  misc_feature 1..25: note = Synthetic Construct
  source 1..25: mol_type = other DNA
ggacagcccaaagaatttgaacttg

SEQ ID NO: 42195 - DNA, 20 bp, synthetic construct
  misc_feature 1..20: note = Synthetic Construct
  source 1..20: mol_type = other DNA
tcccaggattggctgctaca

SEQ ID NO: 42196 - DNA, 22 bp, synthetic construct
  misc_feature 1..22: note = Synthetic Construct
  source 1..22: mol_type = other DNA
cccctgggaacagtgcaaagaa

SEQ ID NO: 42197 - DNA, 22 bp, synthetic construct
  misc_feature 1..22: note = Synthetic Construct
  source 1..22: mol_type = other DNA
aacaggctttgtgactgctttg

SEQ ID NO: 42198 - DNA, 25 bp, synthetic construct
  misc_feature 1..25: note = Synthetic Construct
  source 1..25: mol_type = other DNA
cactttatcttcaggtccgccaatc

SEQ ID NO: 42199 - DNA, 25 bp, synthetic construct
  misc_feature 1..25: note = Synthetic Construct
  source 1..25: mol_type = other DNA
cctgaagtctggtctgttcctaaag

SEQ ID NO: 42200 - DNA, 20 bp, synthetic construct
  misc_feature 1..20: note = Synthetic Construct
  source 1..20: mol_type = other DNA
tgctgctgagtggggattga

SEQ ID NO: 42201 - DNA, 22 bp, synthetic construct
  misc_feature 1..22: note = Synthetic Construct
  source 1..22: mol_type = other DNA
gggcgacggagtaagtctttgt

SEQ ID NO: 42202 - DNA, 19 bp, synthetic construct
  misc_feature 1..19: note = Synthetic Construct
  source 1..19: mol_type = other DNA
agctggccctgtggaggaa

SEQ ID NO: 42203 - DNA, 20 bp, synthetic construct
  misc_feature 1..20: note = Synthetic Construct
  source 1..20: mol_type = other DNA
acctcctcaggggtgcagta

SEQ ID NO: 42204 - DNA, 22 bp, synthetic construct
  misc_feature 1..22: note = Synthetic Construct
  source 1..22: mol_type = other DNA
gcagggaagatggcttcgtttc

SEQ ID NO: 42205 - DNA, 20 bp, synthetic construct
  misc_feature 1..20: note = Synthetic Construct
  source 1..20: mol_type = other DNA
gccccaggtgcaacaacatt

SEQ ID NO: 42206 - DNA, 23 bp, synthetic construct
  misc_feature 1..23: note = Synthetic Construct
  source 1..23: mol_type = other DNA
agaccacgagtgaggatgaaaag

SEQ ID NO: 42207 - DNA, 20 bp, synthetic construct
  misc_feature 1..20: note = Synthetic Construct
  source 1..20: mol_type = other DNA
tgtcaccggcacccacttac

SEQ ID NO: 42208 - DNA, 21 bp, synthetic construct
  misc_feature 1..21: note = Synthetic Construct
  source 1..21: mol_type = other DNA
cccatgtgagctgttgtgtca

SEQ ID NO: 42209 - DNA, 22 bp, synthetic construct
  misc_feature 1..22: note = Synthetic Construct
  source 1..22: mol_type = other DNA
gcctggagaagcatgctagaga

SEQ ID NO: 42210 - DNA, 21 bp, synthetic construct
  misc_feature 1..21: note = Synthetic Construct
  source 1..21: mol_type = other DNA
tcacggccacagtccatcaac

SEQ ID NO: 42211 - DNA, 22 bp, synthetic construct
  misc_feature 1..22: note = Synthetic Construct
  source 1..22: mol_type = other DNA
tcctgacttaggagcggtgtga

SEQ ID NO: 42212 - DNA, 21 bp, synthetic construct
  misc_feature 1..21: note = Synthetic Construct
  source 1..21: mol_type = other DNA
gccatcatgcagcctgacaac

SEQ ID NO: 42213 - DNA, 26 bp, synthetic construct
  misc_feature 1..26: note = Synthetic Construct
  source 1..26: mol_type = other DNA
ggtagtcaagagatgatggtgtctct

SEQ ID NO: 42214 - DNA, 21 bp, synthetic construct
  misc_feature 1..21: note = Synthetic Construct
  source 1..21: mol_type = other DNA
agtcgtggctcggatctgtga

SEQ ID NO: 42215 - DNA, 26 bp, synthetic construct
  misc_feature 1..26: note = Synthetic Construct
  source 1..26: mol_type = other DNA
gacccattataaacagagctggacta

SEQ ID NO: 42216 - DNA, 25 bp, synthetic construct
  misc_feature 1..25: note = Synthetic Construct
  source 1..25: mol_type = other DNA
ttttgcaatgagaatccacctcttc

SEQ ID NO: 42217 - DNA, 23 bp, synthetic construct
  misc_feature 1..23: note = Synthetic Construct
  source 1..23: mol_type = other DNA
tttgacagaggacactcccaaag

SEQ ID NO: 42218 - DNA, 22 bp, synthetic construct
  misc_feature 1..22: note = Synthetic Construct
  source 1..22: mol_type = other DNA
cctgtgctgtcgttgcctatac

SEQ ID NO: 42219 - DNA, 24 bp, synthetic construct
  misc_feature 1..24: note = Synthetic Construct
  source 1..24: mol_type = other DNA
ctgtgataaaccatggagcctact

SEQ ID NO: 42220 - DNA, 20 bp, synthetic construct
  misc_feature 1..20: note = Synthetic Construct
  source 1..20: mol_type = other DNA
gcttggaagagctgggcttt

SEQ ID NO: 42221 - DNA, 20 bp, synthetic construct
  misc_feature 1..20: note = Synthetic Construct
  source 1..20: mol_type = other DNA
tggagagccagatgcaggaa

SEQ ID NO: 42222 - DNA, 22 bp, synthetic construct
  misc_feature 1..22: note = Synthetic Construct
  source 1..22: mol_type = other DNA
ccaggacatcgatcaggacact

SEQ ID NO: 42223 - DNA, 23 bp, synthetic construct
  misc_feature 1..23: note = Synthetic Construct
  source 1..23: mol_type = other DNA
gggaacctttggagaggtagatg

SEQ ID NO: 42224 - DNA, 19 bp, synthetic construct
  misc_feature 1..19: note = Synthetic Construct
  source 1..19: mol_type = other DNA
atggacagccccagtgcaa

SEQ ID NO: 42225 - DNA, 19 bp, synthetic construct
  misc_feature 1..19: note = Synthetic Construct
  source 1..19: mol_type = other DNA
acgctggctggaggagcaa

SEQ ID NO: 42226 - DNA, 22 bp, synthetic construct
  misc_feature 1..22: note = Synthetic Construct
  source 1..22: mol_type = other DNA
ctgtcatacttcggccctcatc

SEQ ID NO: 42227 - DNA, 25 bp, synthetic construct
  misc_feature 1..25: note = Synthetic Construct
  source 1..25: mol_type = other DNA
cacatgctgtatttactggctgctt

SEQ ID NO: 42228 - DNA, 27 bp, synthetic construct
  misc_feature 1..27: note = Synthetic Construct
  source 1..27: mol_type = other DNA
ggcttaggcagggatctaggcatataa

SEQ ID NO: 42229 - DNA, 22 bp, synthetic construct
  misc_feature 1..22: note = Synthetic Construct
  source 1..22: mol_type = other DNA
tccctacagctggagctcattg

SEQ ID NO: 42230 - DNA, 23 bp, synthetic construct
  misc_feature 1..23: note = Synthetic Construct
  source 1..23: mol_type = other DNA
tctacctaccacgctggtattct

SEQ ID NO: 42231 - DNA, 26 bp, synthetic construct
  misc_feature 1..26: note = Synthetic Construct
  source 1..26: mol_type = other DNA
ggagatgagaaacagaccccttaaac

SEQ ID NO: 42232 - DNA, 22 bp, synthetic construct
  misc_feature 1..22: note = Synthetic Construct
  source 1..22: mol_type = other DNA
aggcaggttgaatcccctctca

SEQ ID NO: 42233 - DNA, 23 bp, synthetic construct
  misc_feature 1..23: note = Synthetic Construct
  source 1..23: mol_type = other DNA
tgcttgttagctaaggacaccat

SEQ ID NO: 42234 - DNA, 20 bp, synthetic construct
  misc_feature 1..20: note = Synthetic Construct
  source 1..20: mol_type = other DNA
ggtgtcgtctgcagcaaagt

SEQ ID NO: 42235 - DNA, 20 bp, synthetic construct
  misc_feature 1..20: note = Synthetic Construct
  source 1..20: mol_type = other DNA
agatgctgctctggcagtga

SEQ ID NO: 42236 - DNA, 20 bp, synthetic construct
  misc_feature 1..20: note = Synthetic Construct
  source 1..20: mol_type = other DNA
gctgcctgcacacggataaa

SEQ ID NO: 42237 - DNA, 26 bp, synthetic construct
  misc_feature 1..26: note = Synthetic Construct
  source 1..26: mol_type = other DNA
gcaagtctctaagatcagcccagatt

SEQ ID NO: 42238 - DNA, 27 bp, synthetic construct
  misc_feature 1..27: note = Synthetic Construct
  source 1..27: mol_type = other DNA
gcatctgcaaacaaatctgtcctccaa

SEQ ID NO: 42239 - DNA, 23 bp, synthetic construct
  misc_feature 1..23: note = Synthetic Construct
  source 1..23: mol_type = other DNA
tcctccatccacccctctacctt

SEQ ID NO: 42240 - DNA, 26 bp, synthetic construct
  misc_feature 1..26: note = Synthetic Construct
  source 1..26: mol_type = other DNA
ggtgtttccagattgccagtttcttc

SEQ ID NO: 42241 - DNA, 19 bp, synthetic construct
  misc_feature 1..19: note = Synthetic Construct
  source 1..19: mol_type = other DNA
gccatctgcctgccctgaa

SEQ ID NO: 42242 - DNA, 21 bp, synthetic construct
  misc_feature 1..21: note = Synthetic Construct
  source 1..21: mol_type = other DNA
aggagacagagctcgcaggat

SEQ ID NO: 42243 - DNA, 27 bp, synthetic construct
  misc_feature 1..27: note = Synthetic Construct
  source 1..27: mol_type = other DNA
ctcatgaattaagacaaggcctcttga

SEQ ID NO: 42244 - DNA, 22 bp, synthetic construct
  misc_feature 1..22: note = Synthetic Construct
  source 1..22: mol_type = other DNA
ggagaaaggctgtagggacttc

SEQ ID NO: 42245 - DNA, 19 bp, synthetic construct
  misc_feature 1..19: note = Synthetic Construct
  source 1..19: mol_type = other DNA
tttgtgggccacgccaatg

SEQ ID NO: 42246 - DNA, 20 bp, synthetic construct
  misc_feature 1..20: note = Synthetic Construct
  source 1..20: mol_type = other DNA
tcagcagctcttcccagcat

SEQ ID NO: 42247 - DNA, 23 bp, synthetic construct
  misc_feature 1..23: note = Synthetic Construct
  source 1..23: mol_type = other DNA
gtctgttccccttgaacctgtgt

SEQ ID NO: 42248 - DNA, 22 bp, synthetic construct
  misc_feature 1..22: note = Synthetic Construct
  source 1..22: mol_type = other DNA
gtcttaaggcagctgtggtttg

SEQ ID NO: 42249 - DNA, 22 bp, synthetic construct
  misc_feature 1..22: note = Synthetic Construct
  source 1..22: mol_type = other DNA
gaaaatctggggctctgctcaa

SEQ ID NO: 42250 - DNA, 20 bp, synthetic construct
  misc_feature 1..20: note = Synthetic Construct
  source 1..20: mol_type = other DNA
ggcaaggtgaatggggatgt

SEQ ID NO: 42251 - DNA, 23 bp, synthetic construct
  misc_feature 1..23: note = Synthetic Construct
  source 1..23: mol_type = other DNA
ccgccctttccgtatcagaaact

SEQ ID NO: 42252 - DNA, 20 bp, synthetic construct
  misc_feature 1..20: note = Synthetic Construct
  source 1..20: mol_type = other DNA
aagtggcaggcctcatcttc

SEQ ID NO: 42253 - DNA, 22 bp, synthetic construct
  misc_feature 1..22: note = Synthetic Construct
  source 1..22: mol_type = other DNA
gggacaagtcaggggcatctta

SEQ ID NO: 42254 - DNA, 30 bp, synthetic construct
  misc_feature 1..30: note = Synthetic Construct
  source 1..30: mol_type = other DNA
gagacagaaaaactaagactcactctcctt

SEQ ID NO: 42255 - DNA, 23 bp, synthetic construct
  misc_feature 1..23: note = Synthetic Construct
  source 1..23: mol_type = other DNA
gcccaaaacataccttggagtca

SEQ ID NO: 42256 - DNA, 21 bp, synthetic construct
  misc_feature 1..21: note = Synthetic Construct
  source 1..21: mol_type = other DNA
agagtgccagcccctgatgta

SEQ ID NO: 42257 - DNA, 24 bp, synthetic construct
  misc_feature 1..24: note = Synthetic Construct
  source 1..24: mol_type = other DNA
gcccaaggagggtaactagtccat

SEQ ID NO: 42258 - DNA, 20 bp, synthetic construct
  misc_feature 1..20: note = Synthetic Construct
  source 1..20: mol_type = other DNA
gaagaccaaggtgccagcat

SEQ ID NO: 42259 - DNA, 22 bp, synthetic construct
  misc_feature 1..22: note = Synthetic Construct
  source 1..22: mol_type = other DNA
ctggtcctatggccaccttaga

SEQ ID NO: 42260 - DNA, 22 bp, synthetic construct
  misc_feature 1..22: note = Synthetic Construct
  source 1..22: mol_type = other DNA
agtctctatggggagggtcaac

SEQ ID NO: 42261 - DNA, 20 bp, synthetic construct
  misc_feature 1..20: note = Synthetic Construct
  source 1..20: mol_type = other DNA
acagcagctccaacccattc

SEQ ID NO: 42262 - DNA, 20 bp, synthetic construct
  misc_feature 1..20: note = Synthetic Construct
  source 1..20: mol_type = other DNA
ccgcggtgtaaggactgaat

SEQ ID NO: 42263 - DNA, 25 bp, synthetic construct
  misc_feature 1..25: note = Synthetic Construct
  source 1..25: mol_type = other DNA
ccagtcacttctgtgttacctgtca

SEQ ID NO: 42264 - DNA, 23 bp, synthetic construct
  misc_feature 1..23: note = Synthetic Construct
  source 1..23: mol_type = other DNA
gggcctgatgtccatgatgattc

SEQ ID NO: 42265 - DNA, 25 bp, synthetic construct
  misc_feature 1..25: note = Synthetic Construct
  source 1..25: mol_type = other DNA
gtgttttagatgggctacagcaatg

SEQ ID NO: 42266 - DNA, 21 bp, synthetic construct
  misc_feature 1..21: note = Synthetic Construct
  source 1..21: mol_type = other DNA
gtggaatgccatgtgcctttg

SEQ ID NO: 42267 - DNA, 22 bp, synthetic construct
  misc_feature 1..22: note = Synthetic Construct
  source 1..22: mol_type = other DNA
gctggacgaagacaagcctctt

SEQ ID NO: 42268 - DNA, 25 bp, synthetic construct
  misc_feature 1..25: note = Synthetic Construct
  source 1..25: mol_type = other DNA
tgtccgactacacttggatatttgt

SEQ ID NO: 42269 - DNA, 24 bp, synthetic construct
  misc_feature 1..24: note = Synthetic Construct
  source 1..24: mol_type = other DNA
ggtcgggctagtggatagtctttg

SEQ ID NO: 42270 - DNA, 20 bp, synthetic construct
  misc_feature 1..20: note = Synthetic Construct
  source 1..20: mol_type = other DNA
tgacgtgggatgagggatgt

SEQ ID NO: 42271 - DNA, 23 bp, synthetic construct
  misc_feature 1..23: note = Synthetic Construct
  source 1..23: mol_type = other DNA
tcttgaacagctccttcccctta

SEQ ID NO: 42272 - DNA, 24 bp, synthetic construct
  misc_feature 1..24: note = Synthetic Construct
  source 1..24: mol_type = other DNA
ggttccaagtttgaaagcccttag

SEQ ID NO: 42273 - DNA, 21 bp, synthetic construct
  misc_feature 1..21: note = Synthetic Construct
  source 1..21: mol_type = other DNA
tctccaagtctgtcgtgcaaa

SEQ ID NO: 42274 - DNA, 27 bp, synthetic construct
  misc_feature 1..27: note = Synthetic Construct
  source 1..27: mol_type = other DNA
ggtgcttgactaggaagctaaagaatc

SEQ ID NO: 42275 - DNA, 21 bp, synthetic construct
  misc_feature 1..21: note = Synthetic Construct
  source 1..21: mol_type = other DNA
gggctgaagacgggtgactaa

SEQ ID NO: 42276 - DNA, 23 bp, synthetic construct
  misc_feature 1..23: note = Synthetic Construct
  source 1..23: mol_type = other DNA
ggatgtggaactcaaccctggaa

SEQ ID NO: 42277 - DNA, 21 bp, synthetic construct
  misc_feature 1..21: note = Synthetic Construct
  source 1..21: mol_type = other DNA
cacacttcgcttccggattca

SEQ ID NO: 42278 - DNA, 26 bp, synthetic construct
  misc_feature 1..26: note = Synthetic Construct
  source 1..26: mol_type = other DNA
ccagaaagcagaagggaattggcatt

SEQ ID NO: 42279 - DNA, 25 bp, synthetic construct
  misc_feature 1..25: note = Synthetic Construct
  source 1..25: mol_type = other DNA
ctccaaatatgacttccccttccat

SEQ ID NO: 42280 - DNA, 21 bp, synthetic construct
  misc_feature 1..21: note = Synthetic Construct
  source 1..21: mol_type = other DNA
cctctggcagttcgccatcta

SEQ ID NO: 42281 - DNA, 20 bp, synthetic construct
  misc_feature 1..20: note = Synthetic Construct
  source 1..20: mol_type = other DNA
ggttagcaagcctgcgacaa

SEQ ID NO: 42282 - DNA, 20 bp, synthetic construct
  misc_feature 1..20: note = Synthetic Construct
  source 1..20: mol_type = other DNA
gctgctgggcgaccataaat

SEQ ID NO: 42283 - DNA, 24 bp, synthetic construct
  misc_feature 1..24: note = Synthetic Construct
  source 1..24: mol_type = other DNA
gagtatgatgctcccaagcctaga

SEQ ID NO: 42284 - DNA, 21 bp, synthetic construct
  misc_feature 1..21: note = Synthetic Construct
  source 1..21: mol_type = other DNA
ggagccagtgaaggtttctga

SEQ ID NO: 42285 - DNA, 21 bp, synthetic construct
  misc_feature 1..21: note = Synthetic Construct
  source 1..21: mol_type = other DNA
cccctaccaagccaggatgta

SEQ ID NO: 42286 - DNA, 24 bp, synthetic construct
  misc_feature 1..24: note = Synthetic Construct
  source 1..24: mol_type = other DNA
acaagggagtgaaatgttctgtct

SEQ ID NO: 42287 - DNA, 20 bp, synthetic construct
  misc_feature 1..20: note = Synthetic Construct
  source 1..20: mol_type = other DNA
aaccacaggcctggctgata

SEQ ID NO: 42288 - DNA, 20 bp, synthetic construct
  misc_feature 1..20: note = Synthetic Construct
  source 1..20: mol_type = other DNA
actgcaaccccaaccagtct

SEQ ID NO: 42289 - DNA, 28 bp, synthetic construct
  misc_feature 1..28: note = Synthetic Construct
  source 1..28: mol_type = other DNA
gcatagaggaccgaagaatgttttgaac

SEQ ID NO: 42290 - DNA, 24 bp, synthetic construct
  misc_feature 1..24: note = Synthetic Construct
  source 1..24: mol_type = other DNA
caggtgagaggagggttcagttag

SEQ ID NO: 42291 - DNA, 23 bp, synthetic construct
  misc_feature 1..23: note = Synthetic Construct
  source 1..23: mol_type = other DNA
acaggtcctgacagcattagtga

SEQ ID NO: 42292 - DNA, 24 bp, synthetic construct
  misc_feature 1..24: note = Synthetic Construct
  source 1..24: mol_type = other DNA
gtgagaaaagcagggaccctattg

SEQ ID NO: 42293 - DNA, 20 bp, synthetic construct
  misc_feature 1..20: note = Synthetic Construct
  source 1..20: mol_type = other DNA
tggctccacagggactgatt

SEQ ID NO: 42294 - DNA, 22 bp, synthetic construct
  misc_feature 1..22: note = Synthetic Construct
  source 1..22: mol_type = other DNA
atggaatggggagagacaggat

SEQ ID NO: 42295 - DNA, 24 bp, synthetic construct
  misc_feature 1..24: note = Synthetic Construct
  source 1..24: mol_type = other DNA
gagtccttaccccaggtattctca

SEQ ID NO: 42296 - DNA, 20 bp, synthetic construct
  misc_feature 1..20: note = Synthetic Construct
  source 1..20: mol_type = other DNA
gcaccaggcttctcagcatt

SEQ ID NO: 42297 - DNA, 23 bp, synthetic construct
  misc_feature 1..23: note = Synthetic Construct
  source 1..23: mol_type = other DNA
ctaacctctctttgctgggaaca

SEQ ID NO: 42298 - DNA, 20 bp, synthetic construct
  misc_feature 1..20: note = Synthetic Construct
  source 1..20: mol_type = other DNA
tggaggtgcactgctcagat

SEQ ID NO: 42299 - DNA, 25 bp, synthetic construct
  misc_feature 1..25: note = Synthetic Construct
  source 1..25: mol_type = other DNA
gtccattgagtcaaaattcccagtt

SEQ ID NO: 42300 - DNA, 22 bp, synthetic construct
  misc_feature 1..22: note = Synthetic Construct
  source 1..22: mol_type = other DNA
gactgaccttgccaccctgtaa

SEQ ID NO: 42301 - DNA, 22 bp, synthetic construct
  misc_feature 1..22: note = Synthetic Construct
  source 1..22: mol_type = other DNA
cattgcacccgtaagtcctttg

SEQ ID NO: 42302 - DNA, 23 bp, synthetic construct
  misc_feature 1..23: note = Synthetic Construct
  source 1..23: mol_type = other DNA
ggttccagtatggtggaggaatg

SEQ ID NO: 42303 - DNA, 23 bp, synthetic construct
  misc_feature 1..23: note = Synthetic Construct
  source 1..23: mol_type = other DNA
gtgcgaggaaataggggtgattg

SEQ ID NO: 42304 - DNA, 23 bp, synthetic construct
  misc_feature 1..23: note = Synthetic Construct
  source 1..23: mol_type = other DNA
tgaccagaaagattggcagcatt

SEQ ID NO: 42305 - DNA, 25 bp, synthetic construct
  misc_feature 1..25: note = Synthetic Construct
  source 1..25: mol_type = other DNA
ctttgagcaacactgatggagaaga

SEQ ID NO: 42306 - DNA, 20 bp, synthetic construct
  misc_feature 1..20: note = Synthetic Construct
  source 1..20: mol_type = other DNA
aggtgactggctgtgctaga

SEQ ID NO: 42307 - DNA, 20 bp, synthetic construct
  misc_feature 1..20: note = Synthetic Construct
  source 1..20: mol_type = other DNA
cagccaacagccacatgagt

SEQ ID NO: 42308 - DNA, 21 bp, synthetic construct
  misc_feature 1..21: note = Synthetic Construct
  source 1..21: mol_type = other DNA
ttcagggctggtgctctccat

SEQ ID NO: 42309 - DNA, 27 bp, synthetic construct
  misc_feature 1..27: note = Synthetic Construct
  source 1..27: mol_type = other DNA
cagttgctataccaagagggtttattc

SEQ ID NO: 42310 - DNA, 22 bp, synthetic construct
  misc_feature 1..22: note = Synthetic Construct
  source 1..22: mol_type = other DNA
gccagtgtaagtcctggagtct

SEQ ID NO: 42311 - DNA, 21 bp, synthetic construct
  misc_feature 1..21: note = Synthetic Construct
  source 1..21: mol_type = other DNA
tctttttgggcgctgtgttct

SEQ ID NO: 42312 - DNA, 21 bp, synthetic construct
  misc_feature 1..21: note = Synthetic Construct
  source 1..21: mol_type = other DNA
tgagtgaccgagagcctggaa

SEQ ID NO: 42313 - DNA, 23 bp, synthetic construct
  misc_feature 1..23: note = Synthetic Construct
  source 1..23: mol_type = other DNA
cctcacactggtagccatgcttt

SEQ ID NO: 42314 - DNA, 25 bp, synthetic construct
  misc_feature 1..25: note = Synthetic Construct
  source 1..25: mol_type = other DNA
gacagagcatccccttatctgaatc

SEQ ID NO: 42315 - DNA, 25 bp, synthetic construct
  misc_feature 1..25: note = Synthetic Construct
  source 1..25: mol_type = other DNA
gggaacagataggtagcatggagta

SEQ ID NO: 42316 - DNA, 25 bp, synthetic construct
  misc_feature 1..25: note = Synthetic Construct
  source 1..25: mol_type = other DNA
gcacagcacttaggtcagagagaga

SEQ ID NO: 42317 - DNA, 24 bp, synthetic construct
  misc_feature 1..24: note = Synthetic Construct
  source 1..24: mol_type = other DNA
gcttccaaactgaactgcttccaa

SEQ ID NO: 42318 - DNA, 22 bp, synthetic construct
  misc_feature 1..22: note = Synthetic Construct
  source 1..22: mol_type = other DNA
gcaaatgaggtcgtgtttggaa

SEQ ID NO: 42319 - DNA, 22 bp, synthetic construct
  misc_feature 1..22: note = Synthetic Construct
  source 1..22: mol_type = other DNA
gccaggcacagatagctccata

SEQ ID NO: 42320 - DNA, 24 bp, synthetic construct
  misc_feature 1..24: note = Synthetic Construct
  source 1..24: mol_type = other DNA
ttcccaaatcaagaacccttcctt

SEQ ID NO: 42321 - DNA, 24 bp, synthetic construct
  misc_feature 1..24: note = Synthetic Construct
  source 1..24: mol_type = other DNA
agcatgaatgggagaatagcaagt

SEQ ID NO: 42322 - DNA, 23 bp, synthetic construct
  misc_feature 1..23: note = Synthetic Construct
  source 1..23: mol_type = other DNA
gcaaagctggatctgtggctgtt

SEQ ID NO: 42323 - DNA, 24 bp, synthetic construct
  misc_feature 1..24: note = Synthetic Construct
  source 1..24: mol_type = other DNA
cagaaaggtctgcttaagggctat

SEQ ID NO: 42324 - DNA, 27 bp, synthetic construct
  misc_feature 1..27: note = Synthetic Construct
  source 1..27: mol_type = other DNA
ggaggtattcaatgagacagcaggtat

SEQ ID NO: 42325 - DNA, 19 bp, synthetic construct
  misc_feature 1..19: note = Synthetic Construct
  source 1..19: mol_type = other DNA
ccagttcccctggctctga

SEQ ID NO: 42326 - DNA, 25 bp, synthetic construct
  misc_feature 1..25: note = Synthetic Construct
  source 1..25: mol_type = other DNA
ttctctagcacaaagctctccatag

SEQ ID NO: 42327 - DNA, 25 bp, synthetic construct
  misc_feature 1..25: note = Synthetic Construct
  source 1..25: mol_type = other DNA
gtaactctgcaacaaccttgtgtaa

SEQ ID NO: 42328 - DNA, 20 bp, synthetic construct
  misc_feature 1..20: note = Synthetic Construct
  source 1..20: mol_type = other DNA
cctccaactcctgggctcaa

SEQ ID NO: 42329 - DNA, 26 bp, synthetic construct
  misc_feature 1..26: note = Synthetic Construct
  source 1..26: mol_type = other DNA
gcatctgccctacattctatggtttg

SEQ ID NO: 42330 - DNA, 21 bp, synthetic construct
  misc_feature 1..21: note = Synthetic Construct
  source 1..21: mol_type = other DNA
tgcttgttgcttttgcaccat

SEQ ID NO: 42331 - DNA, 24 bp, synthetic construct
  misc_feature 1..24: note = Synthetic Construct
  source 1..24: mol_type = other DNA
aaggtaaaactctgaaccgtctgt

SEQ ID NO: 42332 - DNA, 25 bp, synthetic construct
  misc_feature 1..25: note = Synthetic Construct
  source 1..25: mol_type = other DNA
cctgctattcctcccataggcacat

SEQ ID NO: 42333 - DNA, 22 bp, synthetic construct
  misc_feature 1..22: note = Synthetic Construct
  source 1..22: mol_type = other DNA
tccacagtggctgttcagaatc

SEQ ID NO: 42334 - DNA, 28 bp, synthetic construct
  misc_feature 1..28: note = Synthetic Construct
  source 1..28: mol_type = other DNA
gtcctcttgttttcccttagttgtgaag

SEQ ID NO: 42335 - DNA, 25 bp, synthetic construct
  misc_feature 1..25: note = Synthetic Construct
  source 1..25: mol_type = other DNA
tgttactacttcagctggcatctac

SEQ ID NO: 42336 - DNA, 23 bp, synthetic construct
  misc_feature 1..23: note = Synthetic Construct
  source 1..23: mol_type = other DNA
ggaaagagtgggaaggactgtgt

SEQ ID NO: 42337 - DNA, 23 bp, synthetic construct
  misc_feature 1..23: note = Synthetic Construct
  source 1..23: mol_type = other DNA
ggcagtaatgggcagtaagttct

SEQ ID NO: 42338 - DNA, 25 bp, synthetic construct
  misc_feature 1..25: note = Synthetic Construct
  source 1..25: mol_type = other DNA
cgactaccaagtttctggaggaaag

SEQ ID NO: 42339 - DNA, 20 bp, synthetic construct
  misc_feature 1..20: note = Synthetic Construct
  source 1..20: mol_type = other DNA
agggctgctgcacaggattt

SEQ ID NO: 42340 - DNA, 20 bp, synthetic construct
  misc_feature 1..20: note = Synthetic Construct
  source 1..20: mol_type = other DNA
gcttttgttgcctgggcttt

SEQ ID NO: 42341 - DNA, 20 bp, synthetic construct
  misc_feature 1..20: note = Synthetic Construct
  source 1..20: mol_type = other DNA
tcccctgtcctcctgctctt

SEQ ID NO: 42342 - DNA, 20 bp, synthetic construct
  misc_feature 1..20: note = Synthetic Construct
  source 1..20: mol_type = other DNA
acaggccaagcctgctcaga

SEQ ID NO: 42343 - DNA, 24 bp, synthetic construct
  misc_feature 1..24: note = Synthetic Construct
  source 1..24: mol_type = other DNA
cacatttggaaaggaccccagtca

SEQ ID NO: 42344 - DNA, 22 bp, synthetic construct
  misc_feature 1..22: note = Synthetic Construct
  source 1..22: mol_type = other DNA
cctccgcagatcttggagatga

SEQ ID NO: 42345 - DNA, 26 bp, synthetic construct
  misc_feature 1..26: note = Synthetic Construct
  source 1..26: mol_type = other DNA
ggcaaaccaatagcaaagagccaact

SEQ ID NO: 42346 - DNA, 23 bp, synthetic construct
  misc_feature 1..23: note = Synthetic Construct
  source 1..23: mol_type = other DNA
tgcaaacaacccaggaaggtaag

SEQ ID NO: 42347 - DNA, 19 bp, synthetic construct
  misc_feature 1..19: note = Synthetic Construct
  source 1..19: mol_type = other DNA
ttgtggcggcgacgtggta

SEQ ID NO: 42348 - DNA, 22 bp, synthetic construct
  misc_feature 1..22: note = Synthetic Construct
  source 1..22: mol_type = other DNA
tgacctgagagagggtccaaag

SEQ ID NO: 42349 - DNA, 24 bp, synthetic construct
  misc_feature 1..24: note = Synthetic Construct
  source 1..24: mol_type = other DNA
gatggcattatatcagggctgtgt

SEQ ID NO: 42350 - DNA, 20 bp, synthetic construct
  misc_feature 1..20: note = Synthetic Construct
  source 1..20: mol_type = other DNA
tgcccctagccttgaagttg

SEQ ID NO: 42351 - DNA, 21 bp, synthetic construct
  misc_feature 1..21: note = Synthetic Construct
  source 1..21: mol_type = other DNA
ccaccgtgcctgaccaattct

SEQ ID NO: 42352 - DNA, 25 bp, synthetic construct
  misc_feature 1..25: note = Synthetic Construct
  source 1..25: mol_type = other DNA
cgctttcccaatgtaccaggtctca

SEQ ID NO: 42353 - DNA, 25 bp, synthetic construct
  misc_feature 1..25: note = Synthetic Construct
  source 1..25: mol_type = other DNA
gctctaatagctacgggcaatggat

SEQ ID NO: 42354 - DNA, 24 bp, synthetic construct
  misc_feature 1..24: note = Synthetic Construct
  source 1..24: mol_type = other DNA
ggtttgaccctcaacatgtgtcat

SEQ ID NO: 42355 - DNA, 23 bp, synthetic construct
  misc_feature 1..23: note = Synthetic Construct
  source 1..23: mol_type = other DNA
gtcgaatctaccctcgtcagctt

SEQ ID NO: 42356 - DNA, 20 bp, synthetic construct
  misc_feature 1..20: note = Synthetic Construct
  source 1..20: mol_type = other DNA
tctctccaggcttggtcctt

SEQ ID NO: 42357 - DNA, 25 bp, synthetic construct
  misc_feature 1..25: note = Synthetic Construct
  source 1..25: mol_type = other DNA
tgtgtagaattttacgtgggcctaa

SEQ ID NO: 42358 - DNA, 22 bp, synthetic construct
  misc_feature 1..22: note = Synthetic Construct
  source 1..22: mol_type = other DNA
gtgtctggggtagtcacagatg

SEQ ID NO: 42359 - DNA, 22 bp, synthetic construct
  misc_feature 1..22: note = Synthetic Construct
  source 1..22: mol_type = other DNA
cataccaaccaaggaggctgaa

SEQ ID NO: 42360 - DNA, 26 bp, synthetic construct
  misc_feature 1..26: note = Synthetic Construct
  source 1..26: mol_type = other DNA
gcaactatcagggtgaagaaccattg

SEQ ID NO: 42361 - DNA, 22 bp, synthetic construct
  misc_feature 1..22: note = Synthetic Construct
  source 1..22: mol_type = other DNA
ctcctggactcaagcaatccat

SEQ ID NO: 42362 - DNA, 23 bp, synthetic construct
  misc_feature 1..23: note = Synthetic Construct
  source 1..23: mol_type = other DNA
ttccttcaaagcagagggtcatt

SEQ ID NO: 42363 - DNA, 20 bp, synthetic construct
  misc_feature 1..20: note = Synthetic Construct
  source 1..20: mol_type = other DNA
tgccccaaggctagtgttct

SEQ ID NO: 42364 - DNA, 29 bp, synthetic construct
  misc_feature 1..29: note = Synthetic Construct
  source 1..29: mol_type = other DNA
ggcattttgactgtggatctttgctcttg

SEQ ID NO: 42365 - DNA, 20 bp, synthetic construct
  misc_feature 1..20: note = Synthetic Construct
  source 1..20: mol_type = other DNA
cttggctgcttttggcaagt

SEQ ID NO: 42366 - DNA, 23 bp, synthetic construct
  misc_feature 1..23: note = Synthetic Construct
  source 1..23: mol_type = other DNA
atctacctggcctgaaagacaag

SEQ ID NO: 42367 - DNA, 22 bp, synthetic construct
  misc_feature 1..22: note = Synthetic Construct
  source 1..22: mol_type = other DNA
gcacggctgggtggaaataagt

SEQ ID NO: 42368 - DNA, 22 bp, synthetic construct
  misc_feature 1..22: note = Synthetic Construct
  source 1..22: mol_type = other DNA
gcatgaaggtggcagtggactt

SEQ ID NO: 42369 - DNA, 25 bp, synthetic construct
  misc_feature 1..25: note = Synthetic Construct
  source 1..25: mol_type = other DNA
ggaaagatttgccaaaggttgtcta

SEQ ID NO: 42370 - DNA, 20 bp, synthetic construct
  misc_feature 1..20: note = Synthetic Construct
  source 1..20: mol_type = other DNA
ggcttctgtgcaccctggaa

SEQ ID NO: 42371 - DNA, 22 bp, synthetic construct
  misc_feature 1..22: note = Synthetic Construct
  source 1..22: mol_type = other DNA
gtgttgggaggctctggaatca

SEQ ID NO: 42372 - DNA, 20 bp, synthetic construct
  misc_feature 1..20: note = Synthetic Construct
  source 1..20: mol_type = other DNA
gccagcaagcagctacacat

SEQ ID NO: 42373 - DNA, 23 bp, synthetic construct
  misc_feature 1..23: note = Synthetic Construct
  source 1..23: mol_type = other DNA
caccgctatgtcctctccatttc

SEQ ID NO: 42374 - DNA, 22 bp, synthetic construct
  misc_feature 1..22: note = Synthetic Construct
  source 1..22: mol_type = other DNA
ccagaggaatgcaggagtcaga

SEQ ID NO: 42375 - DNA, 20 bp, synthetic construct
  misc_feature 1..20: note = Synthetic Construct
  source 1..20: mol_type = other DNA
actctgtgaaggggctgagt

SEQ ID NO: 42376 - DNA, 29 bp, synthetic construct
  misc_feature 1..29: note = Synthetic Construct
  source 1..29: mol_type = other DNA
gggtgagataaactgtttcagtggttttc

SEQ ID NO: 42377 - DNA, 21 bp, synthetic construct
  misc_feature 1..21: note = Synthetic Construct
  source 1..21: mol_type = other DNA
aaaagctcctggctgtgtcat

SEQ ID NO: 42378 - DNA, 20 bp, synthetic construct
  misc_feature 1..20: note = Synthetic Construct
  source 1..20: mol_type = other DNA
ggaggtaggtggggcacaaa

SEQ ID NO: 42379 - DNA, 24 bp, synthetic construct
  misc_feature 1..24: note = Synthetic Construct
  source 1..24: mol_type = other DNA
ggatcccaaagcactttacacatc

SEQ ID NO: 42380 - DNA, 23 bp, synthetic construct
  misc_feature 1..23: note = Synthetic Construct
  source 1..23: mol_type = other DNA
gctaaacaggattccaggctttg

SEQ ID NO: 42381 - DNA, 22 bp, synthetic construct
  misc_feature 1..22: note = Synthetic Construct
  source 1..22: mol_type = other DNA
ctgaacacaaacctgcctgaca

SEQ ID NO: 42382 - DNA, 25 bp, synthetic construct
  misc_feature 1..25: note = Synthetic Construct
  source 1..25: mol_type = other DNA
ccaatgtcagaactagaagggaact

SEQ ID NO: 42383 - DNA, 22 bp, synthetic construct
  misc_feature 1..22: note = Synthetic Construct
  source 1..22: mol_type = other DNA
tgtagagtccctctgggcttca

SEQ ID NO: 42384 - DNA, 23 bp, synthetic construct
  misc_feature 1..23: note = Synthetic Construct
  source 1..23: mol_type = other DNA
ccttctcctaccctcccactaca

SEQ ID NO: 42385 - DNA, 22 bp, synthetic construct
  misc_feature 1..22: note = Synthetic Construct
  source 1..22: mol_type = other DNA
gtgactctgctttccaccatgt

SEQ ID NO: 42386 - DNA, 20 bp, synthetic construct
  misc_feature 1..20: note = Synthetic Construct
  source 1..20: mol_type = other DNA
ttggcagctcaggggtttag

SEQ ID NO: 42387 - DNA, 21 bp, synthetic construct
  misc_feature 1..21: note = Synthetic Construct
  source 1..21: mol_type = other DNA
ttgagggcctttgctcaagaa

SEQ ID NO: 42388 - DNA, 21 bp, synthetic construct
  misc_feature 1..21: note = Synthetic Construct
  source 1..21: mol_type = other DNA
ggcgtcacagtcctgatggtt

SEQ ID NO: 42389 - DNA, 20 bp, synthetic construct
  misc_feature 1..20: note = Synthetic Construct
  source 1..20: mol_type = other DNA
ctgcttggccacagaagaca

SEQ ID NO: 42390 - DNA, 19 bp, synthetic construct
  misc_feature 1..19: note = Synthetic Construct
  source 1..19: mol_type = other DNA
gcccagggctgtctccttt

SEQ ID NO: 42391 - DNA, 30 bp, synthetic construct
  misc_feature 1..30: note = Synthetic Construct
  source 1..30: mol_type = other DNA
cctcttggaagatacctaaatcaacacaca

SEQ ID NO: 42392 - DNA, 25 bp, synthetic construct
  misc_feature 1..25: note = Synthetic Construct
  source 1..25: mol_type = other DNA
gacttcctaagagcaaggacctagt

SEQ ID NO: 42393 - DNA, 20 bp, synthetic construct
  misc_feature 1..20: note = Synthetic Construct
  source 1..20: mol_type = other DNA
cgcgcccggccttatatagt

SEQ ID NO: 42394 - DNA, 24 bp, synthetic construct
  misc_feature 1..24: note = Synthetic Construct
  source 1..24: mol_type = other DNA
aagaccctctggcctttttagttt

SEQ ID NO: 42395 - DNA, 22 bp, synthetic construct
  misc_feature 1..22: note = Synthetic Construct
  source 1..22: mol_type = other DNA
gtgggttttcccatgctcattc

SEQ ID NO: 42396 - DNA, 22 bp, synthetic construct
  misc_feature 1..22: note = Synthetic Construct
  source 1..22: mol_type = other DNA
cggtcttcccatcacctgcaat

SEQ ID NO: 42397 - DNA, 22 bp, synthetic construct
  misc_feature 1..22: note = Synthetic Construct
  source 1..22: mol_type = other DNA
ggaacagtaggcactggggatt

SEQ ID NO: 42398 - DNA, 23 bp, synthetic construct
  misc_feature 1..23: note = Synthetic Construct
  source 1..23: mol_type = other DNA
acctcaccgtacttgttctctct

SEQ ID NO: 42399 - DNA, 22 bp, synthetic construct
  misc_feature 1..22: note = Synthetic Construct
  source 1..22: mol_type = other DNA
gtcatgtccctcaggtgtgttg

SEQ ID NO: 42400 - DNA, 21 bp, synthetic construct
  misc_feature 1..21: note = Synthetic Construct
  source 1..21: mol_type = other DNA
acagaggactggccccacaaa

SEQ ID NO: 42401 - DNA, 24 bp, synthetic construct
  misc_feature 1..24: note = Synthetic Construct
  source 1..24: mol_type = other DNA
gttccatcagattggcttgtgtca

SEQ ID NO: 42402 - DNA, 21 bp, synthetic construct
  misc_feature 1..21: note = Synthetic Construct
  source 1..21: mol_type = other DNA
ggcagcacattgcacaagact

SEQ ID NO: 42403 - DNA, 22 bp, synthetic construct
  misc_feature 1..22: note = Synthetic Construct
  source 1..22: mol_type = other DNA
gtcctccagggcctcagatatt

SEQ ID NO: 42404 - DNA, 23 bp, synthetic construct
  misc_feature 1..23: note = Synthetic Construct
  source 1..23: mol_type = other DNA
ctggcttgactttctgccctcta

SEQ ID NO: 42405 - DNA, 24 bp, synthetic construct
  misc_feature 1..24: note = Synthetic Construct
  source 1..24: mol_type = other DNA
cctcttaaggccttgtcccagaag

SEQ ID NO: 42406 - DNA, 20 bp, synthetic construct
  misc_feature 1..20: note = Synthetic Construct
  source 1..20: mol_type = other DNA
aggccccgagatgggaacta

SEQ ID NO: 42407 - DNA, 20 bp, synthetic construct
  misc_feature 1..20: note = Synthetic Construct
  source 1..20: mol_type = other DNA
tcctcttgccgtgggatctt

SEQ ID NO: 42408 - DNA, 23 bp, synthetic construct
  misc_feature 1..23: note = Synthetic Construct
  source 1..23: mol_type = other DNA
gatggagtttgtcccttcgtttg

SEQ ID NO: 42409 - DNA, 23 bp, synthetic construct
  misc_feature 1..23: note = Synthetic Construct
  source 1..23: mol_type = other DNA
ccatcagtgggagctgaaaaaca

SEQ ID NO: 42410 - DNA, 21 bp, synthetic construct
  misc_feature 1..21: note = Synthetic Construct
  source 1..21: mol_type = other DNA
acctgcatctgtgcctgatct

SEQ ID NO: 42411 - DNA, 21 bp, synthetic construct
  misc_feature 1..21: note = Synthetic Construct
  source 1..21: mol_type = other DNA
cctgctgccatctggggaaaa

SEQ ID NO: 42412 - DNA, 20 bp, synthetic construct
  misc_feature 1..20: note = Synthetic Construct
  source 1..20: mol_type = other DNA
tgcctcctgcaaaggtcaga

SEQ ID NO: 42413 - DNA, 24 bp, synthetic construct
  misc_feature 1..24: note = Synthetic Construct
  source 1..24: mol_type = other DNA
ccctccaaatctgagctggccttt

SEQ ID NO: 42414 - DNA, 19 bp, synthetic construct
  misc_feature 1..19: note = Synthetic Construct
  source 1..19: mol_type = other DNA
tgggctgcgagtgctgaaa

SEQ ID NO: 42415 - DNA, 22 bp, synthetic construct
  misc_feature 1..22: note = Synthetic Construct
  source 1..22: mol_type = other DNA
caggacccaagctgtctggaaa

SEQ ID NO: 42416 - DNA, 20 bp, synthetic construct
  misc_feature 1..20: note = Synthetic Construct
  source 1..20: mol_type = other DNA
ttctgccctacccagagcat

SEQ ID NO: 42417 - DNA, 26 bp, synthetic construct
  misc_feature 1..26: note = Synthetic Construct
  source 1..26: mol_type = other DNA
tcatacacccagatataccgatcact

SEQ ID NO: 42418 - DNA, 18 bp, synthetic construct
  misc_feature 1..18: note = Synthetic Construct
  source 1..18: mol_type = other DNA
actcagcaggcccacctt

SEQ ID NO: 42419 - DNA, 26 bp, synthetic construct
  misc_feature 1..26: note = Synthetic Construct
  source 1..26: mol_type = other DNA
ggggaaggtttatttcctctccaact

SEQ ID NO: 42420 - DNA, 20 bp, synthetic construct
  misc_feature 1..20: note = Synthetic Construct
  source 1..20: mol_type = other DNA
attccctgtccccagactgt

SEQ ID NO: 42421 - DNA, 22 bp, synthetic construct
  misc_feature 1..22: note = Synthetic Construct
  source 1..22: mol_type = other DNA
ggcgaggtgttgtgatcctttg

SEQ ID NO: 42422 - DNA, 21 bp, synthetic construct
  misc_feature 1..21: note = Synthetic Construct
  source 1..21: mol_type = other DNA
tgaacgaggactctgggacat

SEQ ID NO: 42423 - DNA, 23 bp, synthetic construct
  misc_feature 1..23: note = Synthetic Construct
  source 1..23: mol_type = other DNA
tttggaggcaaccagatgttttg

SEQ ID NO: 42424 - DNA, 21 bp, synthetic construct
  misc_feature 1..21: note = Synthetic Construct
  source 1..21: mol_type = other DNA
gatggttgagatggcgagagt

SEQ ID NO: 42425 - DNA, 24 bp, synthetic construct
  misc_feature 1..24: note = Synthetic Construct
  source 1..24: mol_type = other DNA
gccaacccttccctttatccacta

SEQ ID NO: 42426 - DNA, 24 bp, synthetic construct
  misc_feature 1..24: note = Synthetic Construct
  source 1..24: mol_type = other DNA
tgaaagccttgccatattcccatt

SEQ ID NO: 42427 - DNA, 21 bp, synthetic construct
  misc_feature 1..21: note = Synthetic Construct
  source 1..21: mol_type = other DNA
ggggttgaacacttccagtga

SEQ ID NO: 42428 - DNA, 24 bp, synthetic construct
  misc_feature 1..24: note = Synthetic Construct
  source 1..24: mol_type = other DNA
ctggctgatgaaaagtccctgatg

SEQ ID NO: 42429 - DNA, 24 bp, synthetic construct
  misc_feature 1..24: note = Synthetic Construct
  source 1..24: mol_type = other DNA
ggctcctcaagattgactccaaca

SEQ ID NO: 42430 - DNA, 27 bp, synthetic construct
  misc_feature 1..27: note = Synthetic Construct
  source 1..27: mol_type = other DNA
cacctgcttttctatagttgccctgaa

SEQ ID NO: 42431 - DNA, 26 bp, synthetic construct
  misc_feature 1..26: note = Synthetic Construct
  source 1..26: mol_type = other DNA
caaaactgaggccaaagctatcaaag

SEQ ID NO: 42432 - DNA, 21 bp, synthetic construct
  misc_feature 1..21: note = Synthetic Construct
  source 1..21: mol_type = other DNA
ggggactaccaggtggcctaa

SEQ ID NO: 42433 - DNA, 21 bp, synthetic construct
  misc_feature 1..21: note = Synthetic Construct
  source 1..21: mol_type = other DNA
cctcctctgccctgcttagat

SEQ ID NO: 42434 - DNA, 24 bp, synthetic construct
  misc_feature 1..24: note = Synthetic Construct
  source 1..24: mol_type = other DNA
ggactaggtggtatgtagctggta

SEQ ID NO: 42435 - DNA, 25 bp, synthetic construct
  misc_feature 1..25: note = Synthetic Construct
  source 1..25: mol_type = other DNA
ctctctacccaaggtgtcaaacact

SEQ ID NO: 42436 - DNA, 25 bp, synthetic construct
  misc_feature 1..25: note = Synthetic Construct
  source 1..25: mol_type = other DNA
gagtaactcaaagacaggggtttgt

SEQ ID NO: 42437 - DNA, 24 bp, synthetic construct
  misc_feature 1..24: note = Synthetic Construct
  source 1..24: mol_type = other DNA
cctctctctagaaagggaggatca

SEQ ID NO: 42438 - DNA, 20 bp, synthetic construct
  misc_feature 1..20: note = Synthetic Construct
  source 1..20: mol_type = other DNA
tctaatggagggccgtgaca

SEQ ID NO: 42439 - DNA, 24 bp, synthetic construct
  misc_feature 1..24: note = Synthetic Construct
  source 1..24: mol_type = other DNA
cactaacaacaacctgcagagcta

SEQ ID NO: 42440 - DNA, 21 bp, synthetic construct
  misc_feature 1..21: note = Synthetic Construct
  source 1..21: mol_type = other DNA
tcaggcctggttcaacagttc

SEQ ID NO: 42441 - DNA, 21 bp, synthetic construct
  misc_feature 1..21: note = Synthetic Construct
  source 1..21: mol_type = other DNA
tgggcctgcctttgcctaaga

SEQ ID NO: 42442 - DNA, 27 bp, synthetic construct
  misc_feature 1..27: note = Synthetic Construct
  source 1..27: mol_type = other DNA
ggcaaaacagttaagtctctgtgttca

SEQ ID NO: 42443 - DNA, 21 bp, synthetic construct
  misc_feature 1..21: note = Synthetic Construct
  source 1..21: mol_type = other DNA
gtgtgactgagcaggctttga

SEQ ID NO: 42444 - DNA, 19 bp, synthetic construct
  misc_feature 1..19: note = Synthetic Construct
  source 1..19: mol_type = other DNA
aggcagcccaggcagtgaa

SEQ ID NO: 42445 - DNA, 20 bp, synthetic construct
  misc_feature 1..20: note = Synthetic Construct
  source 1..20: mol_type = other DNA
gggaggaacagcccacctat

SEQ ID NO: 42446 - DNA, 21 bp, synthetic construct
  misc_feature 1..21: note = Synthetic Construct
  source 1..21: mol_type = other DNA
ttcctggcctgggctaactct

SEQ ID NO: 42447 - DNA, 22 bp, synthetic construct
  misc_feature 1..22: note = Synthetic Construct
  source 1..22: mol_type = other DNA
tggcaggaaggacagacgtaga

SEQ ID NO: 42448 - DNA, 20 bp, synthetic construct
  misc_feature 1..20: note = Synthetic Construct
  source 1..20: mol_type = other DNA
gccttatggggcacagcaaa

SEQ ID NO: 42449 - DNA, 23 bp, synthetic construct
  misc_feature 1..23: note = Synthetic Construct
  source 1..23: mol_type = other DNA
ggagcatctgtcagacccaagaa

SEQ ID NO: 42450 - DNA, 24 bp, synthetic construct
  misc_feature 1..24: note = Synthetic Construct
  source 1..24: mol_type = other DNA
gccaaagcttaatcctaccctact

SEQ ID NO: 42451 - DNA, 24 bp, synthetic construct
  misc_feature 1..24: note = Synthetic Construct
  source 1..24: mol_type = other DNA
tcagtcatttgtcacagtccagtt

SEQ ID NO: 42452 - DNA, 25 bp, synthetic construct
  misc_feature 1..25: note = Synthetic Construct
  source 1..25: mol_type = other DNA
ccattacttccccttcccctgtttg

SEQ ID NO: 42453 - DNA, 19 bp, synthetic construct
  misc_feature 1..19: note = Synthetic Construct
  source 1..19: mol_type = other DNA
tatggccagggccacagaa

SEQ ID NO: 42454 - DNA, 21 bp, synthetic construct
  misc_feature 1..21: note = Synthetic Construct
  source 1..21: mol_type = other DNA
tcagttgtgtgctgctggtat

SEQ ID NO: 42455 - DNA, 20 bp, synthetic construct
  misc_feature 1..20: note = Synthetic Construct
  source 1..20: mol_type = other DNA
tgtgtaacacgccagagcaa

SEQ ID NO: 42456 - DNA, 25 bp, synthetic construct
  misc_feature 1..25: note = Synthetic Construct
  source 1..25: mol_type = other DNA
ggactatggagacgtgaaggacatt

SEQ ID NO: 42457 - DNA, 29 bp, synthetic construct
  misc_feature 1..29: note = Synthetic Construct
  source 1..29: mol_type = other DNA
ctgacattttactcaaggtggctgtttag

SEQ ID NO: 42458 - DNA, 22 bp, synthetic construct
  misc_feature 1..22: note = Synthetic Construct
  source 1..22: mol_type = other DNA
ccacggacagccaaagaactgt

SEQ ID NO: 42459 - DNA, 22 bp, synthetic construct
  misc_feature 1..22: note = Synthetic Construct
  source 1..22: mol_type = other DNA
gacaaccacagccactggaaag

SEQ ID NO: 42460 - DNA, 28 bp, synthetic construct
  misc_feature 1..28: note = Synthetic Construct
  source 1..28: mol_type = other DNA
gcagcctctctagaccttagaggtaaac

SEQ ID NO: 42461 - DNA, 20 bp, synthetic construct
  misc_feature 1..20: note = Synthetic Construct
  source 1..20: mol_type = other DNA
tctgagcctgaagcccacta

SEQ ID NO: 42462 - DNA, 23 bp, synthetic construct
  misc_feature 1..23: note = Synthetic Construct
  source 1..23: mol_type = other DNA
gcttaggtctcagcaagggtatg

SEQ ID NO: 42463 - DNA, 21 bp, synthetic construct
  misc_feature 1..21: note = Synthetic Construct
  source 1..21: mol_type = other DNA
gcccacttccttgagtgatga

SEQ ID NO: 42464 - DNA, 20 bp, synthetic construct
  misc_feature 1..20: note = Synthetic Construct
  source 1..20: mol_type = other DNA
ggccaagtgagtggacttga

SEQ ID NO: 42465 - DNA, 25 bp, synthetic construct
  misc_feature 1..25: note = Synthetic Construct
  source 1..25: mol_type = other DNA
gggtaaaagtgagtctcatctcagt

SEQ ID NO: 42466 - DNA, 29 bp, synthetic construct
  misc_feature 1..29: note = Synthetic Construct
  source 1..29: mol_type = other DNA
cccatgtgaaagtgggattttagctgtca

SEQ ID NO: 42467 - DNA, 22 bp, synthetic construct
  misc_feature 1..22: note = Synthetic Construct
  source 1..22: mol_type = other DNA
agaagccattaagcccctccta

SEQ ID NO: 42468 - DNA, 27 bp, synthetic construct
  misc_feature 1..27: note = Synthetic Construct
  source 1..27: mol_type = other DNA
ccttactcaatttacccaagcaagaga

SEQ ID NO: 42469 - DNA, 24 bp, synthetic construct
  misc_feature 1..24: note = Synthetic Construct
  source 1..24: mol_type = other DNA
gcttggaaaagcagcaattggtaa

SEQ ID NO: 42470 - DNA, 25 bp, synthetic construct
  misc_feature 1..25: note = Synthetic Construct
  source 1..25: mol_type = other DNA
cctagcaacaggaaaccagttcaga

SEQ ID NO: 42471 - DNA, 24 bp, synthetic construct
  misc_feature 1..24: note = Synthetic Construct
  source 1..24: mol_type = other DNA
ggtaaagaggaagcaagacacctt

SEQ ID NO: 42472 - DNA, 26 bp, synthetic construct
  misc_feature 1..26: note = Synthetic Construct
  source 1..26: mol_type = other DNA
gccacctgctgattgtagagtcttag

SEQ ID NO: 42473 - DNA, 21 bp, synthetic construct
  misc_feature 1..21: note = Synthetic Construct
  source 1..21: mol_type = other DNA
gaagaccagaagcctcagcaa

SEQ ID NO: 42474 - DNA, 20 bp, synthetic construct
  misc_feature 1..20: note = Synthetic Construct
  source 1..20: mol_type = other DNA
cagctggcttggggcttcta

SEQ ID NO: 42475 - DNA, 24 bp, synthetic construct
  misc_feature 1..24: note = Synthetic Construct
  source 1..24: mol_type = other DNA
ccacttgtagtctgggtggtgaag

SEQ ID NO: 42476 - DNA, 24 bp, synthetic construct
  misc_feature 1..24: note = Synthetic Construct
  source 1..24: mol_type = other DNA
gcctacatttctagggccctcact

SEQ ID NO: 42477 - DNA, 22 bp, synthetic construct
  misc_feature 1..22: note = Synthetic Construct
  source 1..22: mol_type = other DNA
tggagtgcttaggggaggattg

SEQ ID NO: 42478 - DNA, 22 bp, synthetic construct
  misc_feature 1..22: note = Synthetic Construct
  source 1..22: mol_type = other DNA
agggaggagaaaaggctgaaga

SEQ ID NO: 42479 - DNA, 22 bp, synthetic construct
  misc_feature 1..22: note = Synthetic Construct
  source 1..22: mol_type = other DNA
gctgctgtccctaacccaagaa

SEQ ID NO: 42480 - DNA, 22 bp, synthetic construct
  misc_feature 1..22: note = Synthetic Construct
  source 1..22: mol_type = other DNA
agcctaggcctggacttgaaga

SEQ ID NO: 42481 - DNA, 20 bp, synthetic construct
  misc_feature 1..20: note = Synthetic Construct
  source 1..20: mol_type = other DNA
cagcagagtggtgggacaaa

SEQ ID NO: 42482 - DNA, 20 bp, synthetic construct
  misc_feature 1..20: note = Synthetic Construct
  source 1..20: mol_type = other DNA
aacaccaggccagagagaca

SEQ ID NO: 42483 - DNA, 23 bp, synthetic construct
  misc_feature 1..23: note = Synthetic Construct
  source 1..23: mol_type = other DNA
cagtcagcaagtccctccataca

SEQ ID NO: 42484 - DNA, 22 bp, synthetic construct
  misc_feature 1..22: note = Synthetic Construct
  source 1..22: mol_type = other DNA
ggctgcttttccttgacacaac

SEQ ID NO: 42485 - DNA, 21 bp, synthetic construct
  misc_feature 1..21: note = Synthetic Construct
  source 1..21: mol_type = other DNA
atcaacgctacaggcagtgaa

SEQ ID NO: 42486 - DNA, 24 bp, synthetic construct
  misc_feature 1..24: note = Synthetic Construct
  source 1..24: mol_type = other DNA
gctctatccactgtggtcatgcta

SEQ ID NO: 42487 - DNA, 26 bp, synthetic construct
  misc_feature 1..26: note = Synthetic Construct
  source 1..26: mol_type = other DNA
ccaggtggagtctgaagtgaactgat

SEQ ID NO: 42488 - DNA, 25 bp, synthetic construct
  misc_feature 1..25: note = Synthetic Construct
  source 1..25: mol_type = other DNA
gaatctggtcatgccagtgattaca

SEQ ID NO: 42489 - DNA, 23 bp, synthetic construct
  misc_feature 1..23: note = Synthetic Construct
  source 1..23: mol_type = other DNA
cctgtgctaggtactgggtcaac

SEQ ID NO: 42490 - DNA, 24 bp, synthetic construct
  misc_feature 1..24: note = Synthetic Construct
  source 1..24: mol_type = other DNA
agtggaacttagcaacatggaagt

SEQ ID NO: 42491 - DNA, 18 bp, synthetic construct
  misc_feature 1..18: note = Synthetic Construct
  source 1..18: mol_type = other DNA
tggggatggcctcagctt

SEQ ID NO: 42492 - DNA, 24 bp, synthetic construct
  misc_feature 1..24: note = Synthetic Construct
  source 1..24: mol_type = other DNA
ctcagtaatggtggatgcccttca

SEQ ID NO: 42493 - DNA, 25 bp, synthetic construct
  misc_feature 1..25: note = Synthetic Construct
  source 1..25: mol_type = other DNA
ctcatggggtatctcaaccactaga

SEQ ID NO: 42494 - DNA, 24 bp, synthetic construct
  misc_feature 1..24: note = Synthetic Construct
  source 1..24: mol_type = other DNA
tggggaatatgtgccttactctca

SEQ ID NO: 42495 - DNA, 20 bp, synthetic construct
  misc_feature 1..20: note = Synthetic Construct
  source 1..20: mol_type = other DNA
ggccaccatctttgctgctt

SEQ ID NO: 42496 - DNA, 22 bp, synthetic construct
  misc_feature 1..22: note = Synthetic Construct
  source 1..22: mol_type = other DNA
ccttcttgtggccccagttttc

SEQ ID NO: 42497 - DNA, 25 bp, synthetic construct
  misc_feature 1..25: note = Synthetic Construct
  source 1..25: mol_type = other DNA
tccttgtctccagaggaaagaattg

SEQ ID NO: 42498 - DNA, 22 bp, synthetic construct
  misc_feature 1..22: note = Synthetic Construct
  source 1..22: mol_type = other DNA
ggtggtcactgtggcattgttc

SEQ ID NO: 42499 - DNA, 22 bp, synthetic construct
  misc_feature 1..22: note = Synthetic Construct
  source 1..22: mol_type = other DNA
tctgtggggcagacaacataga

SEQ ID NO: 42500 - DNA, 24 bp, synthetic construct
  misc_feature 1..24: note = Synthetic Construct
  source 1..24: mol_type = other DNA
cactgtatgctgatggcctgtact

SEQ ID NO: 42501 - DNA, 22 bp, synthetic construct
  misc_feature 1..22: note = Synthetic Construct
  source 1..22: mol_type = other DNA
tcagcaccacaattggtcagaa

SEQ ID NO: 42502 - DNA, 24 bp, synthetic construct
  misc_feature 1..24: note = Synthetic Construct
  source 1..24: mol_type = other DNA
cctatttccacatggcgctaatct

SEQ ID NO: 42503 - DNA, 23 bp, synthetic construct
  misc_feature 1..23: note = Synthetic Construct
  source 1..23: mol_type = other DNA
ctgctaccacctcttgtggtcaa

SEQ ID NO: 42504 - DNA, 25 bp, synthetic construct
  misc_feature 1..25: note = Synthetic Construct
  source 1..25: mol_type = other DNA
tggctcaacttacccaaggataaac

SEQ ID NO: 42505 - DNA, 22 bp, synthetic construct
  misc_feature 1..22: note = Synthetic Construct
  source 1..22: mol_type = other DNA
cagggctccaatcctcttctct

SEQ ID NO: 42506 - DNA, 21 bp, synthetic construct
  misc_feature 1..21: note = Synthetic Construct
  source 1..21: mol_type = other DNA
acaagaacctcccacctgact

SEQ ID NO: 42507 - DNA, 19 bp, synthetic construct
  misc_feature 1..19: note = Synthetic Construct
  source 1..19: mol_type = other DNA
ttcgggtgggaggaaccaa

SEQ ID NO: 42508 - DNA, 22 bp, synthetic construct
  misc_feature 1..22: note = Synthetic Construct
  source 1..22: mol_type = other DNA
ctcgcatcttttctgccagtgt

SEQ ID NO: 42509 - DNA, 20 bp, synthetic construct
  misc_feature 1..20: note = Synthetic Construct
  source 1..20: mol_type = other DNA
gtgttatggcctgcccatct

SEQ ID NO: 42510 - DNA, 23 bp, synthetic construct
  misc_feature 1..23: note = Synthetic Construct
  source 1..23: mol_type = other DNA
ggcaattttctgcctgtgtttct

SEQ ID NO: 42511 - DNA, 25 bp, synthetic construct
  misc_feature 1..25: note = Synthetic Construct
  source 1..25: mol_type = other DNA
cctatgcatctggaggagctaggta

SEQ ID NO: 42512 - DNA, 21 bp, synthetic construct
  misc_feature 1..21: note = Synthetic Construct
  source 1..21: mol_type = other DNA
tggagaatgggctgggtgttg

SEQ ID NO: 42513 - DNA, 24 bp, synthetic construct
  misc_feature 1..24: note = Synthetic Construct
  source 1..24: mol_type = other DNA
gcctcagagtgaagacctctttga

SEQ ID NO: 42514 - DNA, 23 bp, synthetic construct
  misc_feature 1..23: note = Synthetic Construct
  source 1..23: mol_type = other DNA
cttacctgccttcttcccctaga

SEQ ID NO: 42515 - DNA, 21 bp, synthetic construct
  misc_feature 1..21: note = Synthetic Construct
  source 1..21: mol_type = other DNA
aagggcttgtgtttcccaagt

SEQ ID NO: 42516 - DNA, 24 bp, synthetic construct
  misc_feature 1..24: note = Synthetic Construct
  source 1..24: mol_type = other DNA
gctcacaaaccctacacaatggat

SEQ ID NO: 42517 - DNA, 23 bp, synthetic construct
  misc_feature 1..23: note = Synthetic Construct
  source 1..23: mol_type = other DNA
gggtgagaaccaggagagtgtga

SEQ ID NO: 42518 - DNA, 24 bp, synthetic construct
  misc_feature 1..24: note = Synthetic Construct
  source 1..24: mol_type = other DNA
tgactaaaacaggctcagaccatt

SEQ ID NO: 42519 - DNA, 22 bp, synthetic construct
  misc_feature 1..22: note = Synthetic Construct
  source 1..22: mol_type = other DNA
ggacaaggccaagacagtctac

SEQ ID NO: 42520 - DNA, 24 bp, synthetic construct
  misc_feature 1..24: note = Synthetic Construct
  source 1..24: mol_type = other DNA
gtcatccacggatctctcctcttc

SEQ ID NO: 42521 - DNA, 23 bp, synthetic construct
  misc_feature 1..23: note = Synthetic Construct
  source 1..23: mol_type = other DNA
gcgagtctgttgtgagtggatga

SEQ ID NO: 42522 - DNA, 29 bp, synthetic construct
  misc_feature 1..29: note = Synthetic Construct
  source 1..29: mol_type = other DNA
ccctacttgttaaagtctaccccagagat

SEQ ID NO: 42523 - DNA, 21 bp, synthetic construct
  misc_feature 1..21: note = Synthetic Construct
  source 1..21: mol_type = other DNA
acatgtcctgccaatgctcaa

SEQ ID NO: 42524 - DNA, 23 bp, synthetic construct
  misc_feature 1..23: note = Synthetic Construct
  source 1..23: mol_type = other DNA
ggggatttgtgggagctggttac

SEQ ID NO: 42525 - DNA, 26 bp, synthetic construct
  misc_feature 1..26: note = Synthetic Construct
  source 1..26: mol_type = other DNA
cccatatttgaccccttgtgggtgta

SEQ ID NO: 42526 - DNA, 22 bp, synthetic construct
  misc_feature 1..22: note = Synthetic Construct
  source 1..22: mol_type = other DNA
tgatcagccttgaggcaagaga

SEQ ID NO: 42527 - DNA, 28 bp, synthetic construct
  misc_feature 1..28: note = Synthetic Construct
  source 1..28: mol_type = other DNA
ggggtttgtattcagtctgtttgtgtag

SEQ ID NO: 42528 - DNA, 20 bp, synthetic construct
  misc_feature 1..20: note = Synthetic Construct
  source 1..20: mol_type = other DNA
atgcctactggagccagaca

SEQ ID NO: 42529 - DNA, 21 bp, synthetic construct
  misc_feature 1..21: note = Synthetic Construct
  source 1..21: mol_type = other DNA
gcatagcagccttcctgaact

SEQ ID NO: 42530 - DNA, 20 bp, synthetic construct
  misc_feature 1..20: note = Synthetic Construct
  source 1..20: mol_type = other DNA
acagtgcagccaggactcaa

SEQ ID NO: 42531 - DNA, 22 bp, synthetic construct
  misc_feature 1..22: note = Synthetic Construct
  source 1..22: mol_type = other DNA
gaggtgggtagttggcttgaac

SEQ ID NO: 42532 - DNA, 23 bp, synthetic construct
  misc_feature 1..23: note = Synthetic Construct
  source 1..23: mol_type = other DNA
gtgatatgtgcccttcccctttg

SEQ ID NO: 42533 - DNA, 21 bp, synthetic construct
  misc_feature 1..21: note = Synthetic Construct
  source 1..21: mol_type = other DNA
agcaccagaagagagccattg

SEQ ID NO: 42534 - DNA, 24 bp, synthetic construct
  misc_feature 1..24: note = Synthetic Construct
  source 1..24: mol_type = other DNA
aacataccaaccgaaagacagagt

SEQ ID NO: 42535 - DNA, 20 bp, synthetic construct
  misc_feature 1..20: note = Synthetic Construct
  source 1..20: mol_type = other DNA
tagcccatggctctgtctct

SEQ ID NO: 42536 - DNA, 21 bp, synthetic construct
  misc_feature 1..21: note = Synthetic Construct
  source 1..21: mol_type = other DNA
gctcccatagcaacccagcta

SEQ ID NO: 42537 - DNA, 25 bp, synthetic construct
  misc_feature 1..25: note = Synthetic Construct
  source 1..25: mol_type = other DNA
gcagttttcttctacctctggtttg

SEQ ID NO: 42538 - DNA, 25 bp, synthetic construct
  misc_feature 1..25: note = Synthetic Construct
  source 1..25: mol_type = other DNA
tggagttaaaagggctagaaactgt

SEQ ID NO: 42539 - DNA, 25 bp, synthetic construct
  misc_feature 1..25: note = Synthetic Construct
  source 1..25: mol_type = other DNA
cctgtagtgggtaatgtccgtgctt

SEQ ID NO: 42540 - DNA, 22 bp, synthetic construct
  misc_feature 1..22: note = Synthetic Construct
  source 1..22: mol_type = other DNA
gtcagctcactggaccctttct

SEQ ID NO: 42541 - DNA, 22 bp, synthetic construct
  misc_feature 1..22: note = Synthetic Construct
  source 1..22: mol_type = other DNA
ccactctctccaccaagcattc

SEQ ID NO: 42542 - DNA, 27 bp, synthetic construct
  misc_feature 1..27: note = Synthetic Construct
  source 1..27: mol_type = other DNA
gcctatgggattagttttgaacgtaga

SEQ ID NO: 42543 - DNA, 24 bp, synthetic construct
  misc_feature 1..24: note = Synthetic Construct
  source 1..24: mol_type = other DNA
tgctatgacttggaggtgaagact

SEQ ID NO: 42544 - DNA, 21 bp, synthetic construct
  misc_feature 1..21: note = Synthetic Construct
  source 1..21: mol_type = other DNA
aggctgagttccaccctcttg

SEQ ID NO: 42545 - DNA, 23 bp, synthetic construct
  misc_feature 1..23: note = Synthetic Construct
  source 1..23: mol_type = other DNA
gcaggtaatgggtggttttggaa

SEQ ID NO: 42546 - DNA, 24 bp, synthetic construct
  misc_feature 1..24: note = Synthetic Construct
  source 1..24: mol_type = other DNA
gtgtaactctgcccctttctctac

SEQ ID NO: 42547 - DNA, 23 bp, synthetic construct
  misc_feature 1..23: note = Synthetic Construct
  source 1..23: mol_type = other DNA
ggactgtcaaccaggaagtgttg

SEQ ID NO: 42548 - DNA, 24 bp, synthetic construct
  misc_feature 1..24: note = Synthetic Construct
  source 1..24: mol_type = other DNA
gcacaggagacaagctgggaaatc

SEQ ID NO: 42549 - DNA, 27 bp, synthetic construct
  misc_feature 1..27: note = Synthetic Construct
  source 1..27: mol_type = other DNA
ggaacaacaagaggggataacccaaag

SEQ ID NO: 42550 - DNA, 21 bp, synthetic construct
  misc_feature 1..21: note = Synthetic Construct
  source 1..21: mol_type = other DNA
gagcacattccccttgcatct

SEQ ID NO: 42551 - DNA, 22 bp, synthetic construct
  misc_feature 1..22: note = Synthetic Construct
  source 1..22: mol_type = other DNA
cggaagcacagggcatttcaga

SEQ ID NO: 42552 - DNA, 22 bp, synthetic construct
  misc_feature 1..22: note = Synthetic Construct
  source 1..22: mol_type = other DNA
acctgtgaaggggttggggaaa

SEQ ID NO: 42553 - DNA, 23 bp, synthetic construct
  misc_feature 1..23: note = Synthetic Construct
  source 1..23: mol_type = other DNA
ccctcaaactagggaggtagcat

SEQ ID NO: 42554 - DNA, 22 bp, synthetic construct
  misc_feature 1..22: note = Synthetic Construct
  source 1..22: mol_type = other DNA
gctcagtcagccactcaagcta

SEQ ID NO: 42555 - DNA, 25 bp, synthetic construct
  misc_feature 1..25: note = Synthetic Construct
  source 1..25: mol_type = other DNA
caagtcatggtcttgtcctttccta

SEQ ID NO: 42556 - DNA, 24 bp, synthetic construct
  misc_feature 1..24: note = Synthetic Construct
  source 1..24: mol_type = other DNA
ctgcctgcatagcatgagaaatac

SEQ ID NO: 42557 - DNA, 23 bp, synthetic construct
  misc_feature 1..23: note = Synthetic Construct
  source 1..23: mol_type = other DNA
ccacagggaaagtgtaccacgat

SEQ ID NO: 42558 - DNA, 25 bp, synthetic construct
  misc_feature 1..25: note = Synthetic Construct
  source 1..25: mol_type = other DNA
tgagtcaatccagggaacatagtca

SEQ ID NO: 42559 - DNA, 21 bp, synthetic construct
  misc_feature 1..21: note = Synthetic Construct
  source 1..21: mol_type = other DNA
atgtggtcctcagctcctttg

SEQ ID NO: 42560 - DNA, 23 bp, synthetic construct
  misc_feature 1..23: note = Synthetic Construct
  source 1..23: mol_type = other DNA
ccctgttttaatggggccaaatg

SEQ ID NO: 42561 - DNA, 24 bp, synthetic construct
  misc_feature 1..24: note = Synthetic Construct
  source 1..24: mol_type = other DNA
ttgtccacttcagcactttactct

SEQ ID NO: 42562 - DNA, 21 bp, synthetic construct
  misc_feature 1..21: note = Synthetic Construct
  source 1..21: mol_type = other DNA
ctcaagacgccaagagcaaga

SEQ ID NO: 42563 - DNA, 23 bp, synthetic construct
  misc_feature 1..23: note = Synthetic Construct
  source 1..23: mol_type = other DNA
cagggtgacctgaaaagctgcta

SEQ ID NO: 42564 - DNA, 22 bp, synthetic construct
  misc_feature 1..22: note = Synthetic Construct
  source 1..22: mol_type = other DNA
ttcaccctcccttgcaatttga

SEQ ID NO: 42565 - DNA, 27 bp, synthetic construct
  misc_feature 1..27: note = Synthetic Construct
  source 1..27: mol_type = other DNA
cccaaaagaaagcctaggacattgtga

SEQ ID NO: 42566 - DNA, 21 bp, synthetic construct
  misc_feature 1..21: note = Synthetic Construct
  source 1..21: mol_type = other DNA
acagccctagatggccctgtt

SEQ ID NO: 42567 - DNA, 22 bp, synthetic construct
  misc_feature 1..22: note = Synthetic Construct
  source 1..22: mol_type = other DNA
ctccaagttacgctcggtgaag

SEQ ID NO: 42568 - DNA, 21 bp, synthetic construct
  misc_feature 1..21: note = Synthetic Construct
  source 1..21: mol_type = other DNA
cccctgcctgaaatgctgttt

SEQ ID NO: 42569 - DNA, 24 bp, synthetic construct
  misc_feature 1..24: note = Synthetic Construct
  source 1..24: mol_type = other DNA
ggtcagcttgagctgtaacaaaca

SEQ ID NO: 42570 - DNA, 23 bp, synthetic construct
  misc_feature 1..23: note = Synthetic Construct
  source 1..23: mol_type = other DNA
ccagaactggaactgaggctttc

SEQ ID NO: 42571 - DNA, 20 bp, synthetic construct
  misc_feature 1..20: note = Synthetic Construct
  source 1..20: mol_type = other DNA
agaacggtgcctgctgcata

SEQ ID NO: 42572 - DNA, 21 bp, synthetic construct
  misc_feature 1..21: note = Synthetic Construct
  source 1..21: mol_type = other DNA
tggagggtctgcttgatctct

SEQ ID NO: 42573 - DNA, 24 bp, synthetic construct
  misc_feature 1..24: note = Synthetic Construct
  source 1..24: mol_type = other DNA
tcacctgggagtaaagttgtgatg

SEQ ID NO: 42574 - DNA, 25 bp, synthetic construct
  misc_feature 1..25: note = Synthetic Construct
  source 1..25: mol_type = other DNA
gcccagaagagaagagtatttcaga

SEQ ID NO: 42575 - DNA, 22 bp, synthetic construct
  misc_feature 1..22: note = Synthetic Construct
  source 1..22: mol_type = other DNA
cagttcctgggctcaagcaatc

SEQ ID NO: 42576 - DNA, 25 bp, synthetic construct
  misc_feature 1..25: note = Synthetic Construct
  source 1..25: mol_type = other DNA
ggtatggcatcagtttctgctttca

SEQ ID NO: 42577 - DNA, 27 bp, synthetic construct
  misc_feature 1..27: note = Synthetic Construct
  source 1..27: mol_type = other DNA
gctacaaatgagttttccccacaatct

SEQ ID NO: 42578 - DNA, 22 bp, synthetic construct
  misc_feature 1..22: note = Synthetic Construct
  source 1..22: mol_type = other DNA
caggattgcatgcttccagtgt

SEQ ID NO: 42579 - DNA, 24 bp, synthetic construct
  misc_feature 1..24: note = Synthetic Construct
  source 1..24: mol_type = other DNA
gcttgaatgacctgctccattttc

SEQ ID NO: 42580 - DNA, 24 bp, synthetic construct
  misc_feature 1..24: note = Synthetic Construct
  source 1..24: mol_type = other DNA
ggccaagggagtgagagaatccaa

SEQ ID NO: 42581 - DNA, 25 bp, synthetic construct
  misc_feature 1..25: note = Synthetic Construct
  source 1..25: mol_type = other DNA
ggcaatgaagaataccaccaacaga

SEQ ID NO: 42582 - DNA, 22 bp, synthetic construct
  misc_feature 1..22: note = Synthetic Construct
  source 1..22: mol_type = other DNA
gacatgacctggtgggacatca

SEQ ID NO: 42583 - DNA, 20 bp, synthetic construct
  misc_feature 1..20: note = Synthetic Construct
  source 1..20: mol_type = other DNA
atgcctgggagcgcttcatc

SEQ ID NO: 42584 - DNA, 25 bp, synthetic construct
  misc_feature 1..25: note = Synthetic Construct
  source 1..25: mol_type = other DNA
ggccttcaagtattgacaggtcttc

SEQ ID NO: 42585 - DNA, 22 bp, synthetic construct
  misc_feature 1..22: note = Synthetic Construct
  source 1..22: mol_type = other DNA
cagacagagggaggtgcttatg

SEQ ID NO: 42586 - DNA, 20 bp, synthetic construct
  misc_feature 1..20: note = Synthetic Construct
  source 1..20: mol_type = other DNA
aggtggactgacaggcagaa

SEQ ID NO: 42587 - DNA, 22 bp, synthetic construct
  misc_feature 1..22: note = Synthetic Construct
  source 1..22: mol_type = other DNA
actactgaacccctgctctaca

SEQ ID NO: 42588 - DNA, 19 bp, synthetic construct
  misc_feature 1..19: note = Synthetic Construct
  source 1..19: mol_type = other DNA
ggggccagatcctgcattg

SEQ ID NO: 42589 - DNA, 25 bp, synthetic construct
  misc_feature 1..25: note = Synthetic Construct
  source 1..25: mol_type = other DNA
gagctgactccatactgtcaaggaa

SEQ ID NO: 42590 - DNA, 23 bp, synthetic construct
  misc_feature 1..23: note = Synthetic Construct
  source 1..23: mol_type = other DNA
cctggagtgtagggctgtaggat

SEQ ID NO: 42591 - DNA, 22 bp, synthetic construct
  misc_feature 1..22: note = Synthetic Construct
  source 1..22: mol_type = other DNA
gcccatcctacagcctagcaaa

SEQ ID NO: 42592 - DNA, 21 bp, synthetic construct
  misc_feature 1..21: note = Synthetic Construct
  source 1..21: mol_type = other DNA
agatggagtaacggggaccaa

SEQ ID NO: 42593 - DNA, 20 bp, synthetic construct
  misc_feature 1..20: note = Synthetic Construct
  source 1..20: mol_type = other DNA
atggtgcccgggagggtctt

SEQ ID NO: 42594 - DNA, 21 bp, synthetic construct
  misc_feature 1..21: note = Synthetic Construct
  source 1..21: mol_type = other DNA
tgggtactgcccctgcttcat

SEQ ID NO: 42595 - DNA, 22 bp, synthetic construct
  misc_feature 1..22: note = Synthetic Construct
  source 1..22: mol_type = other DNA
gaccacacactctacaccacat

SEQ ID NO: 42596 - DNA, 25 bp, synthetic construct
  misc_feature 1..25: note = Synthetic Construct
  source 1..25: mol_type = other DNA
ggccccagtaaaaacagtgggcatt

SEQ ID NO: 42597 - DNA, 21 bp, synthetic construct
  misc_feature 1..21: note = Synthetic Construct
  source 1..21: mol_type = other DNA
gcctgggcaggtcatgttgtt

SEQ ID NO: 42598 - DNA, 20 bp, synthetic construct
  misc_feature 1..20: note = Synthetic Construct
  source 1..20: mol_type = other DNA
aggggatcgcctctgattct

SEQ ID NO: 42599 - DNA, 21 bp, synthetic construct
  misc_feature 1..21: note = Synthetic Construct
  source 1..21: mol_type = other DNA
acagggtggctactggtctca

SEQ ID NO: 42600 - DNA, 24 bp, synthetic construct
  misc_feature 1..24: note = Synthetic Construct
  source 1..24: mol_type = other DNA
gcttaactttgcctgaaggtgaga

SEQ ID NO: 42601 - DNA, 22 bp, synthetic construct
  misc_feature 1..22: note = Synthetic Construct
  source 1..22: mol_type = other DNA
aaagcagactcagtggggtatg

SEQ ID NO: 42602 - DNA, 21 bp, synthetic construct
  misc_feature 1..21: note = Synthetic Construct
  source 1..21: mol_type = other DNA
caccatgtgtgtggactcgaa

SEQ ID NO: 42603 - DNA, 22 bp, synthetic construct
  misc_feature 1..22: note = Synthetic Construct
  source 1..22: mol_type = other DNA
gcaggtgacatttgagcacgat

SEQ ID NO: 42604 - DNA, 24 bp, synthetic construct
  misc_feature 1..24: note = Synthetic Construct
  source 1..24: mol_type = other DNA
ctcaccaaggcataaagtcagtct

SEQ ID NO: 42605 - DNA, 20 bp, synthetic construct
  misc_feature 1..20: note = Synthetic Construct
  source 1..20: mol_type = other DNA
tggactccacctggcaaatg

SEQ ID NO: 42606 - DNA, 23 bp, synthetic construct
  misc_feature 1..23: note = Synthetic Construct
  source 1..23: mol_type = other DNA
ccaggaaggggtaatagggctta

SEQ ID NO: 42607 - DNA, 21 bp, synthetic construct
  misc_feature 1..21: note = Synthetic Construct
  source 1..21: mol_type = other DNA
aaggggaacacagggctgaga

SEQ ID NO: 42608 - DNA, 25 bp, synthetic construct
  misc_feature 1..25: note = Synthetic Construct
  source 1..25: mol_type = other DNA
ctcattcactgctagtacaggttgt

SEQ ID NO: 42609 - DNA, 22 bp, synthetic construct
  misc_feature 1..22: note = Synthetic Construct
  source 1..22: mol_type = other DNA
cttgtgtaggtgctgactccaa

SEQ ID NO: 42610 - DNA, 22 bp, synthetic construct
  misc_feature 1..22: note = Synthetic Construct
  source 1..22: mol_type = other DNA
gtcccctacttggctgctgatt

SEQ ID NO: 42611 - DNA, 25 bp, synthetic construct
  misc_feature 1..25: note = Synthetic Construct
  source 1..25: mol_type = other DNA
ccaaatggttttccagccagtaaag

SEQ ID NO: 42612 - DNA, 23 bp, synthetic construct
  misc_feature 1..23: note = Synthetic Construct
  source 1..23: mol_type = other DNA
cagctgtcaatgaatggctcctt

SEQ ID NO: 42613 - DNA, 19 bp, synthetic construct
  misc_feature 1..19: note = Synthetic Construct
  source 1..19: mol_type = other DNA
cctcgaggggaaggcatct

SEQ ID NO: 42614 - DNA, 22 bp, synthetic construct
  misc_feature 1..22: note = Synthetic Construct
  source 1..22: mol_type = other DNA
aagcacctgtgactttgtctga

SEQ ID NO: 42615 - DNA, 22 bp, synthetic construct
  misc_feature 1..22: note = Synthetic Construct
  source 1..22: mol_type = other DNA
ggttggaggagagtgtggatgt

SEQ ID NO: 42616 - DNA, 20 bp, synthetic construct
  misc_feature 1..20: note = Synthetic Construct
  source 1..20: mol_type = other DNA
tggggctgtgggactagtgt

SEQ ID NO: 42617 - DNA, 20 bp, synthetic construct
  misc_feature 1..20: note = Synthetic Construct
  source 1..20: mol_type = other DNA
gtggtgacaggacgtggttt

SEQ ID NO: 42618 - DNA, 24 bp, synthetic construct
  misc_feature 1..24: note = Synthetic Construct
  source 1..24: mol_type = other DNA
atccgaactaaccattcactgtgt

SEQ ID NO: 42619 - DNA, 21 bp, synthetic construct
  misc_feature 1..21: note = Synthetic Construct
  source 1..21: mol_type = other DNA
tctctcacagttgggcaggat

SEQ ID NO: 42620 - DNA, 22 bp, synthetic construct
  misc_feature 1..22: note = Synthetic Construct
  source 1..22: mol_type = other DNA
gctgcagtagtccttcctgtct

SEQ ID NO: 42621 - DNA, 20 bp, synthetic construct
  misc_feature 1..20: note = Synthetic Construct
  source 1..20: mol_type = other DNA
ccaggcaactttcccagaca

SEQ ID NO: 42622 - DNA, 25 bp, synthetic construct
  misc_feature 1..25: note = Synthetic Construct
  source 1..25: mol_type = other DNA
ccaaaagtgggttgaagccagatca

SEQ ID NO: 42623 - DNA, 21 bp, synthetic construct
  misc_feature 1..21: note = Synthetic Construct
  source 1..21: mol_type = other DNA
tgcctgcacatcagtgattct

SEQ ID NO: 42624 - DNA, 27 bp, synthetic construct
  misc_feature 1..27: note = Synthetic Construct
  source 1..27: mol_type = other DNA
gtggctattaatcaagatctcgtgcta

SEQ ID NO: 42625 - DNA, 22 bp, synthetic construct
  misc_feature 1..22: note = Synthetic Construct
  source 1..22: mol_type = other DNA
ctgcctcccatctgccatgata

SEQ ID NO: 42626 - DNA, 20 bp, synthetic construct
  misc_feature 1..20: note = Synthetic Construct
  source 1..20: mol_type = other DNA
aaaagccccagcggtgtttg

SEQ ID NO: 42627 - DNA, 20 bp, synthetic construct
  misc_feature 1..20: note = Synthetic Construct
  source 1..20: mol_type = other DNA
gcacagcactgggctttgtt

SEQ ID NO: 42628 - DNA, 23 bp, synthetic construct
  misc_feature 1..23: note = Synthetic Construct
  source 1..23: mol_type = other DNA
cagacagtattcctggccctgta

SEQ ID NO: 42629 - DNA, 22 bp, synthetic construct
  misc_feature 1..22: note = Synthetic Construct
  source 1..22: mol_type = other DNA
caggctggtacctacggattga

SEQ ID NO: 42630 - DNA, 26 bp, synthetic construct
  misc_feature 1..26: note = Synthetic Construct
  source 1..26: mol_type = other DNA
cctctttaggttttggggagaaaaca

SEQ ID NO: 42631 - DNA, 20 bp, synthetic construct
  misc_feature 1..20: note = Synthetic Construct
  source 1..20: mol_type = other DNA
cccagccaggaactttgtca

SEQ ID NO: 42632 - DNA, 23 bp, synthetic construct
  misc_feature 1..23: note = Synthetic Construct
  source 1..23: mol_type = other DNA
ttttgcccttctgtcccttatgt

SEQ ID NO: 42633 - DNA, 22 bp, synthetic construct
  misc_feature 1..22: note = Synthetic Construct
  source 1..22: mol_type = other DNA
gcttgctcacagggtggacatt

SEQ ID NO: 42634 - DNA, 21 bp, synthetic construct
  misc_feature 1..21: note = Synthetic Construct
  source 1..21: mol_type = other DNA
tgatcagagaggcaggtgtga

SEQ ID NO: 42635 - DNA, 25 bp, synthetic construct
  misc_feature 1..25: note = Synthetic Construct
  source 1..25: mol_type = other DNA
gcatctcagtctcccatctttgtgt

SEQ ID NO: 42636 - DNA, 24 bp, synthetic construct
  misc_feature 1..24: note = Synthetic Construct
  source 1..24: mol_type = other DNA
cagggatttgagtccagctgttca

SEQ ID NO: 42637 - DNA, 25 bp, synthetic construct
  misc_feature 1..25: note = Synthetic Construct
  source 1..25: mol_type = other DNA
ggcttggtttttcacttcaggttag

SEQ ID NO: 42638 - DNA, 24 bp, synthetic construct
  misc_feature 1..24: note = Synthetic Construct
  source 1..24: mol_type = other DNA
ggacatcctccctagcaacaccaa

SEQ ID NO: 42639 - DNA, 23 bp, synthetic construct
  misc_feature 1..23: note = Synthetic Construct
  source 1..23: mol_type = other DNA
ggaactcagagccctatggaaag

SEQ ID NO: 42640 - DNA, 25 bp, synthetic construct
  misc_feature 1..25: note = Synthetic Construct
  source 1..25: mol_type = other DNA
ccttctattggcagagaaagtctga

SEQ ID NO: 42641 - DNA, 26 bp, synthetic construct
  misc_feature 1..26: note = Synthetic Construct
  source 1..26: mol_type = other DNA
gacaggttgcttgaaataccctctca

SEQ ID NO: 42642 - DNA, 22 bp, synthetic construct
  misc_feature 1..22: note = Synthetic Construct
  source 1..22: mol_type = other DNA
gtgactgatgggcaggtagcat

SEQ ID NO: 42643 - DNA, 20 bp, synthetic construct
  misc_feature 1..20: note = Synthetic Construct
  source 1..20: mol_type = other DNA
gggagaggccaacagaccaa

SEQ ID NO: 42644 - DNA, 20 bp, synthetic construct
  misc_feature 1..20: note = Synthetic Construct
  source 1..20: mol_type = other DNA
gctccagggagctctaggat

SEQ ID NO: 42645 - DNA, 22 bp, synthetic construct
  misc_feature 1..22: note = Synthetic Construct
  source 1..22: mol_type = other DNA
gggcaaggaagtgggtctttga

SEQ ID NO: 42646 - DNA, 20 bp, synthetic construct
  misc_feature 1..20: note = Synthetic Construct
  source 1..20: mol_type = other DNA
tgcaggactgctgccaggat

SEQ ID NO: 42647 - DNA, 20 bp, synthetic construct
  misc_feature 1..20: note = Synthetic Construct
  source 1..20: mol_type = other DNA
gctgtggcaggtttggtgtt

SEQ ID NO: 42648 - DNA, 24 bp, synthetic construct
  misc_feature 1..24: note = Synthetic Construct
  source 1..24: mol_type = other DNA
gcactcccaagtccagttctaaag

SEQ ID NO: 42649 - DNA, 24 bp, synthetic construct
  misc_feature 1..24: note = Synthetic Construct
  source 1..24: mol_type = other DNA
ctttccaccacttcccatctttct

SEQ ID NO: 42650 - DNA, 27 bp, synthetic construct
  misc_feature 1..27: note = Synthetic Construct
  source 1..27: mol_type = other DNA
ctggagtaaaatgctttaggaccaagt

SEQ ID NO: 42651 - DNA, 25 bp, synthetic construct
  misc_feature 1..25: note = Synthetic Construct
  source 1..25: mol_type = other DNA
aggtaagaaaattggggctcaaaca

SEQ ID NO: 42652 - DNA, 21 bp, synthetic construct
  misc_feature 1..21: note = Synthetic Construct
  source 1..21: mol_type = other DNA
agcaacccctatccccagcaa

SEQ ID NO: 42653 - DNA, 22 bp, synthetic construct
  misc_feature 1..22: note = Synthetic Construct
  source 1..22: mol_type = other DNA
ccctcctgcctgaaacaaccaa

SEQ ID NO: 42654 - DNA, 22 bp, synthetic construct
  misc_feature 1..22: note = Synthetic Construct
  source 1..22: mol_type = other DNA
gggttgttcaccctggaaccta

SEQ ID NO: 42655 - DNA, 23 bp, synthetic construct
  misc_feature 1..23: note = Synthetic Construct
  source 1..23: mol_type = other DNA
gaggggactttaaacctgcagaa

SEQ ID NO: 42656 - DNA, 24 bp, synthetic construct
  misc_feature 1..24: note = Synthetic Construct
  source 1..24: mol_type = other DNA
ggtgaagtctatgctgaccaagtt

SEQ ID NO: 42657 - DNA, 24 bp, synthetic construct
  misc_feature 1..24: note = Synthetic Construct
  source 1..24: mol_type = other DNA
gctttaacttgcctcccagacctt

SEQ ID NO: 42658 - DNA, 28 bp, synthetic construct
  misc_feature 1..28: note = Synthetic Construct
  source 1..28: mol_type = other DNA
ccatctacagacactaaggtagcctctt

SEQ ID NO: 42659 - DNA, 24 bp, synthetic construct
  misc_feature 1..24: note = Synthetic Construct
  source 1..24: mol_type = other DNA
ccctctcttgggcctcagaaaact

SEQ ID NO: 42660 - DNA, 27 bp, synthetic construct
  misc_feature 1..27: note = Synthetic Construct
  source 1..27: mol_type = other DNA
gactgatgatgcaagaaaggcataaac

SEQ ID NO: 42661 - DNA, 23 bp, synthetic construct
  misc_feature 1..23: note = Synthetic Construct
  source 1..23: mol_type = other DNA
ccccagctgtatgttgcaaggtt

SEQ ID NO: 42662 - DNA, 22 bp, synthetic construct
  misc_feature 1..22: note = Synthetic Construct
  source 1..22: mol_type = other DNA
ccagagggaagcagttggaaga

SEQ ID NO: 42663 - DNA, 24 bp, synthetic construct
  misc_feature 1..24: note = Synthetic Construct
  source 1..24: mol_type = other DNA
tttgaaatggcagtgtctgggata

SEQ ID NO: 42664 - DNA, 23 bp, synthetic construct
  misc_feature 1..23: note = Synthetic Construct
  source 1..23: mol_type = other DNA
gcaaatcctggccctactgaaac

SEQ ID NO: 42665 - DNA, 20 bp, synthetic construct
  misc_feature 1..20: note = Synthetic Construct
  source 1..20: mol_type = other DNA
cacctgggcctgaacatcaa

SEQ ID NO: 42666 - DNA, 24 bp, synthetic construct
  misc_feature 1..24: note = Synthetic Construct
  source 1..24: mol_type = other DNA
cactgaagccaaaagccatacaca

SEQ ID NO: 42667 - DNA, 19 bp, synthetic construct
  misc_feature 1..19: note = Synthetic Construct
  source 1..19: mol_type = other DNA
ggctgtgggcgcagataca

SEQ ID NO: 42668 - DNA, 26 bp, synthetic construct
  misc_feature 1..26: note = Synthetic Construct
  source 1..26: mol_type = other DNA
caagaatcctatcctgggaagacaga

SEQ ID NO: 42669 - DNA, 20 bp, synthetic construct
  misc_feature 1..20: note = Synthetic Construct
  source 1..20: mol_type = other DNA
tccacatggggcagcttgaa

SEQ ID NO: 42670 - DNA, 19 bp, synthetic construct
  misc_feature 1..19: note = Synthetic Construct
  source 1..19: mol_type = other DNA
acgggtgtggagcttgtgt

SEQ ID NO: 42671 - DNA, 24 bp, synthetic construct
  misc_feature 1..24: note = Synthetic Construct
  source 1..24: mol_type = other DNA
ccacaatgtgctttgtcccttttc

SEQ ID NO: 42672 - DNA, 26 bp, synthetic construct
  misc_feature 1..26: note = Synthetic Construct
  source 1..26: mol_type = other DNA
ctgaggatgggaaagctgtttcttct

SEQ ID NO: 42673 - DNA, 25 bp, synthetic construct
  misc_feature 1..25: note = Synthetic Construct
  source 1..25: mol_type = other DNA
gttatcattctttggccctccattc

SEQ ID NO: 42674 - DNA, 23 bp, synthetic construct
  misc_feature 1..23: note = Synthetic Construct
  source 1..23: mol_type = other DNA
ggggcaatatagtagcccagaca

SEQ ID NO: 42675 - DNA, 20 bp, synthetic construct
  misc_feature 1..20: note = Synthetic Construct
  source 1..20: mol_type = other DNA
acctactgcccatgcactga

SEQ ID NO: 42676 - DNA, 23 bp, synthetic construct
  misc_feature 1..23: note = Synthetic Construct
  source 1..23: mol_type = other DNA
ctggtcacagcaacctctgattc

SEQ ID NO: 42677 - DNA, 21 bp, synthetic construct
  misc_feature 1..21: note = Synthetic Construct
  source 1..21: mol_type = other DNA
ctctgggcccatttcagcatt

SEQ ID NO: 42678 - DNA, 24 bp, synthetic construct
  misc_feature 1..24: note = Synthetic Construct
  source 1..24: mol_type = other DNA
tgacattgccatcttcacaggaat

SEQ ID NO: 42679 - DNA, 28 bp, synthetic construct
  misc_feature 1..28: note = Synthetic Construct
  source 1..28: mol_type = other DNA
ggcagtttcatttaaggctgactgattc

SEQ ID NO: 42680 - DNA, 21 bp, synthetic construct
  misc_feature 1..21: note = Synthetic Construct
  source 1..21: mol_type = other DNA
gcctgtccaagccctaccaat

SEQ ID NO: 42681 - DNA, 22 bp, synthetic construct
  misc_feature 1..22: note = Synthetic Construct
  source 1..22: mol_type = other DNA
accgaggttcagagaggagaag

SEQ ID NO: 42682 - DNA, 23 bp, synthetic construct
  misc_feature 1..23: note = Synthetic Construct
  source 1..23: mol_type = other DNA
ggtcttgccttatcctgcttttg

SEQ ID NO: 42683 - DNA, 24 bp, synthetic construct
  misc_feature 1..24: note = Synthetic Construct
  source 1..24: mol_type = other DNA
cccatgtgagtccttgtggtccaa

SEQ ID NO: 42684 - DNA, 22 bp, synthetic construct
  misc_feature 1..22: note = Synthetic Construct
  source 1..22: mol_type = other DNA
ccacagtgggttagagcatcaa

SEQ ID NO: 42685 - DNA, 25 bp, synthetic construct
  misc_feature 1..25: note = Synthetic Construct
  source 1..25: mol_type = other DNA
ctggcatggattgtagttgctgaac

SEQ ID NO: 42686 - DNA, 22 bp, synthetic construct
  misc_feature 1..22: note = Synthetic Construct
  source 1..22: mol_type = other DNA
cttctggggaaaccccacctaa

SEQ ID NO: 42687 - DNA, 21 bp, synthetic construct
  misc_feature 1..21: note = Synthetic Construct
  source 1..21: mol_type = other DNA
atgtgagggaggggctggttt

SEQ ID NO: 42688 - DNA, 23 bp, synthetic construct
  misc_feature 1..23: note = Synthetic Construct
  source 1..23: mol_type = other DNA
agtccaacaaacagtgagggaaa

SEQ ID NO: 42689 - DNA, 26 bp, synthetic construct
  misc_feature 1..26: note = Synthetic Construct
  source 1..26: mol_type = other DNA
cagacaccaggactttcttgctgtta

SEQ ID NO: 42690 - DNA, 21 bp, synthetic construct
  misc_feature 1..21: note = Synthetic Construct
  source 1..21: mol_type = other DNA
tcatgcccaccttggaacatc

SEQ ID NO: 42691 - DNA, 23 bp, synthetic construct
  misc_feature 1..23: note = Synthetic Construct
  source 1..23: mol_type = other DNA
gggaggtgagggtcttggtgtaa

SEQ ID NO: 42692 - DNA, 20 bp, synthetic construct
  misc_feature 1..20: note = Synthetic Construct
  source 1..20: mol_type = other DNA
gtgcttccagaggcaaccaa

SEQ ID NO: 42693 - DNA, 27 bp, synthetic construct
  misc_feature 1..27: note = Synthetic Construct
  source 1..27: mol_type = other DNA
gctgcaattccagatgtggtttcattc

SEQ ID NO: 42694 - DNA, 23 bp, synthetic construct
  misc_feature 1..23: note = Synthetic Construct
  source 1..23: mol_type = other DNA
gctccattctgggatggggaaag

SEQ ID NO: 42695 - DNA, 23 bp, synthetic construct
  misc_feature 1..23: note = Synthetic Construct
  source 1..23: mol_type = other DNA
gtctgaagcttggtgcttacaac

SEQ ID NO: 42696 - DNA, 22 bp, synthetic construct
  misc_feature 1..22: note = Synthetic Construct
  source 1..22: mol_type = other DNA
cggggagtagacctgcttgtat

SEQ ID NO: 42697 - DNA, 25 bp, synthetic construct
  misc_feature 1..25: note = Synthetic Construct
  source 1..25: mol_type = other DNA
gacctttgatggactggacttctac

SEQ ID NO: 42698 - DNA, 23 bp, synthetic construct
  misc_feature 1..23: note = Synthetic Construct
  source 1..23: mol_type = other DNA
ccaatcaggtctgtgttcgattg

SEQ ID NO: 42699 - DNA, 26 bp, synthetic construct
  misc_feature 1..26: note = Synthetic Construct
  source 1..26: mol_type = other DNA
gtgccattacaatgaactaccactgt

SEQ ID NO: 42700 - DNA, 23 bp, synthetic construct
  misc_feature 1..23: note = Synthetic Construct
  source 1..23: mol_type = other DNA
cgctgtatgaatggcttgcttga

SEQ ID NO: 42701 - DNA, 24 bp, synthetic construct
  misc_feature 1..24: note = Synthetic Construct
  source 1..24: mol_type = other DNA
gggatagagagtttgcactgagtt

SEQ ID NO: 42702 - DNA, 26 bp, synthetic construct
  misc_feature 1..26: note = Synthetic Construct
  source 1..26: mol_type = other DNA
gacaaaaggctaagaggggagaaatg

SEQ ID NO: 42703 - DNA, 19 bp, synthetic construct
  misc_feature 1..19: note = Synthetic Construct
  source 1..19: mol_type = other DNA
agggtggccaggctagaaa

SEQ ID NO: 42704 - DNA, 21 bp, synthetic construct
  misc_feature 1..21: note = Synthetic Construct
  source 1..21: mol_type = other DNA
ccctttgtccagccccaacat

SEQ ID NO: 42705 - DNA, 21 bp, synthetic construct
  misc_feature 1..21: note = Synthetic Construct
  source 1..21: mol_type = other DNA
gggaggcaaatctctggcaaa

SEQ ID NO: 42706 - DNA, 23 bp, synthetic construct
  misc_feature 1..23: note = Synthetic Construct
  source 1..23: mol_type = other DNA
ccagggatatgggctctgtctac

SEQ ID NO: 42707 - DNA, 24 bp, synthetic construct
  misc_feature 1..24: note = Synthetic Construct
  source 1..24: mol_type = other DNA
gggaagaaggcaaggaaatacact

SEQ ID NO: 42708 - DNA, 23 bp, synthetic construct
  misc_feature 1..23: note = Synthetic Construct
  source 1..23: mol_type = other DNA
ccaggacctagggccaaatttca

SEQ ID NO: 42709 - DNA, 27 bp, synthetic construct
  misc_feature 1..27: note = Synthetic Construct
  source 1..27: mol_type = other DNA
cgcttctttacacttccaactctgctt

SEQ ID NO: 42710 - DNA, 27 bp, synthetic construct
  misc_feature 1..27: note = Synthetic Construct
  source 1..27: mol_type = other DNA
ggactttctaatatgtgtcggctctgt

SEQ ID NO: 42711 - DNA, 26 bp, synthetic construct
  misc_feature 1..26: note = Synthetic Construct
  source 1..26: mol_type = other DNA
ctttagtaaaacagcccaggaagaag

SEQ ID NO: 42712 - DNA, 22 bp, synthetic construct
  misc_feature 1..22: note = Synthetic Construct
  source 1..22: mol_type = other DNA
gatgtgtgcagacttggtccat

SEQ ID NO: 42713 - DNA, 22 bp, synthetic construct
  misc_feature 1..22: note = Synthetic Construct
  source 1..22: mol_type = other DNA
ctggagggagaggggcaaatta

SEQ ID NO: 42714 - DNA, 23 bp, synthetic construct
  misc_feature 1..23: note = Synthetic Construct
  source 1..23: mol_type = other DNA
gactgtgcattcagtctcctttg

SEQ ID NO: 42715 - DNA, 25 bp, synthetic construct
  misc_feature 1..25: note = Synthetic Construct
  source 1..25: mol_type = other DNA
gagtgctgtcatcctaacaccatag

SEQ ID NO: 42716 - DNA, 22 bp, synthetic construct
  misc_feature 1..22: note = Synthetic Construct
  source 1..22: mol_type = other DNA
aggcttttctctccctctgttg

SEQ ID NO: 42717 - DNA, 24 bp, synthetic construct
  misc_feature 1..24: note = Synthetic Construct
  source 1..24: mol_type = other DNA
ccacccctttacttggagttggta

SEQ ID NO: 42718 - DNA, 24 bp, synthetic construct
  misc_feature 1..24: note = Synthetic Construct
  source 1..24: mol_type = other DNA
ctcagtggagatgagtttgcaatg

SEQ ID NO: 42719 - DNA, 22 bp, synthetic construct
  misc_feature 1..22: note = Synthetic Construct
  source 1..22: mol_type = other DNA
ggtgactgagagtggggagact

SEQ ID NO: 42720 - DNA, 22 bp, synthetic construct
  misc_feature 1..22: note = Synthetic Construct
  source 1..22: mol_type = other DNA
tcctggtggtcatccctgaaac

SEQ ID NO: 42721 - DNA, 22 bp, synthetic construct
  misc_feature 1..22: note = Synthetic Construct
  source 1..22: mol_type = other DNA
ccagagacaggaggaagagcaa

SEQ ID NO: 42722 - DNA, 24 bp, synthetic construct
  misc_feature 1..24: note = Synthetic Construct
  source 1..24: mol_type = other DNA
cctcactgaagtcagaaccaggta

SEQ ID NO: 42723 - DNA, 21 bp, synthetic construct
  misc_feature 1..21: note = Synthetic Construct
  source 1..21: mol_type = other DNA
acaggtccgaaaagccattgt

SEQ ID NO: 42724 - DNA, 23 bp, synthetic construct
  misc_feature 1..23: note = Synthetic Construct
  source 1..23: mol_type = other DNA
cctctggggtcacacttatctct

SEQ ID NO: 42725 - DNA, 21 bp, synthetic construct
  misc_feature 1..21: note = Synthetic Construct
  source 1..21: mol_type = other DNA
cctgctgtaaacctggccaaa

SEQ ID NO: 42726 - DNA, 24 bp, synthetic construct
  misc_feature 1..24: note = Synthetic Construct
  source 1..24: mol_type = other DNA
gctaggcaagggtatggaggttca

SEQ ID NO: 42727 - DNA, 20 bp, synthetic construct
  misc_feature 1..20: note = Synthetic Construct
  source 1..20: mol_type = other DNA
tgggactgggccacagaact

SEQ ID NO: 42728 - DNA, 22 bp, synthetic construct
  misc_feature 1..22: note = Synthetic Construct
  source 1..22: mol_type = other DNA
cccatccccacactcctctaca

SEQ ID NO: 42729 - DNA, 24 bp, synthetic construct
  misc_feature 1..24: note = Synthetic Construct
  source 1..24: mol_type = other DNA
cctgagcacaacactgatggtctt

SEQ ID NO: 42730 - DNA, 22 bp, synthetic construct
  misc_feature 1..22: note = Synthetic Construct
  source 1..22: mol_type = other DNA
ttggagggccaggagctacaga

SEQ ID NO: 42731 - DNA, 24 bp, synthetic construct
  misc_feature 1..24: note = Synthetic Construct
  source 1..24: mol_type = other DNA
cccaaggctataaggggtgcttag

SEQ ID NO: 42732 - DNA, 27 bp, synthetic construct
  misc_feature 1..27: note = Synthetic Construct
  source 1..27: mol_type = other DNA
ctgaagacatgtacatctgctctttga

SEQ ID NO: 42733 - DNA, 22 bp, synthetic construct
  misc_feature 1..22: note = Synthetic Construct
  source 1..22: mol_type = other DNA
ggccctttttacaggccctaac

SEQ ID NO: 42734 - DNA, 22 bp, synthetic construct
  misc_feature 1..22: note = Synthetic Construct
  source 1..22: mol_type = other DNA
cgtccctctgcttaaggggaaa

SEQ ID NO: 42735 - DNA, 19 bp, synthetic construct
  misc_feature 1..19: note = Synthetic Construct
  source 1..19: mol_type = other DNA
tccctccctgcccttcaga

SEQ ID NO: 42736 - DNA, 24 bp, synthetic construct
  misc_feature 1..24: note = Synthetic Construct
  source 1..24: mol_type = other DNA
gtcataaacatacgggcagccttt

SEQ ID NO: 42737 - DNA, 23 bp, synthetic construct
  misc_feature 1..23: note = Synthetic Construct
  source 1..23: mol_type = other DNA
gctccttggctgtgtaactgtga

SEQ ID NO: 42738 - DNA, 19 bp, synthetic construct
  misc_feature 1..19: note = Synthetic Construct
  source 1..19: mol_type = other DNA
cggaggtgcgctccataag

SEQ ID NO: 42739 - DNA, 21 bp, synthetic construct
  misc_feature 1..21: note = Synthetic Construct
  source 1..21: mol_type = other DNA
gaagctcaagcccggtaagat

SEQ ID NO: 42740 - DNA, 20 bp, synthetic construct
  misc_feature 1..20: note = Synthetic Construct
  source 1..20: mol_type = other DNA
tgagtcccagggcacccaat

SEQ ID NO: 42741 - DNA, 29 bp, synthetic construct
  misc_feature 1..29: note = Synthetic Construct
  source 1..29: mol_type = other DNA
ggagaacaatactttcccttttggagtag

SEQ ID NO: 42742 - DNA, 30 bp, synthetic construct
  misc_feature 1..30: note = Synthetic Construct
  source 1..30: mol_type = other DNA
ggagctttaattgtctctcaccatccctta

SEQ ID NO: 42743 - DNA, 20 bp, synthetic construct
  misc_feature 1..20: note = Synthetic Construct
  source 1..20: mol_type = other DNA
cgtggcaaggcacaagtgaa

SEQ ID NO: 42744 - DNA, 21 bp, synthetic construct
  misc_feature 1..21: note = Synthetic Construct
  source 1..21: mol_type = other DNA
gacacagtgggatgtgtggtt

SEQ ID NO: 42745 - DNA, 24 bp, synthetic construct
  misc_feature 1..24: note = Synthetic Construct
  source 1..24: mol_type = other DNA
cctctcgccaccatcttgctacta

SEQ ID NO: 42746 - DNA, 19 bp, synthetic construct
  misc_feature 1..19: note = Synthetic Construct
  source 1..19: mol_type = other DNA
ggcccaggcagtagagtca

SEQ ID NO: 42747 - DNA, 24 bp, synthetic construct
  misc_feature 1..24: note = Synthetic Construct
  source 1..24: mol_type = other DNA
ctagatgtcactgcctccctttac

SEQ ID NO: 42748 - DNA, 30 bp, synthetic construct
  misc_feature 1..30: note = Synthetic Construct
  source 1..30: mol_type = other DNA
ccagtttctcagtaaaacaatgcctgttac

SEQ ID NO: 42749 - DNA, 24 bp, synthetic construct
  misc_feature 1..24: note = Synthetic Construct
  source 1..24: mol_type = other DNA
cgtgctgtctgcaaacaacgtcta

SEQ ID NO: 42750 - DNA, 22 bp, synthetic construct
  misc_feature 1..22: note = Synthetic Construct
  source 1..22: mol_type = other DNA
gaggaacaggaggcaagtgttg

SEQ ID NO: 42751 - DNA, 24 bp, synthetic construct
  misc_feature 1..24: note = Synthetic Construct
  source 1..24: mol_type = other DNA
ggcaggcctgataacaggttgtgt

SEQ ID NO: 42752 - DNA, 20 bp, synthetic construct
  misc_feature 1..20: note = Synthetic Construct
  source 1..20: mol_type = other DNA
gcaagctggccatcctgtag

SEQ ID NO: 42753 - DNA, 20 bp, synthetic construct
  misc_feature 1..20: note = Synthetic Construct
  source 1..20: mol_type = other DNA
tccccttacccaggttgcat

SEQ ID NO: 42754 - DNA, 25 bp, synthetic construct
  misc_feature 1..25: note = Synthetic Construct
  source 1..25: mol_type = other DNA
gtcctgaaagcttttggctccattc

SEQ ID NO: 42755 - DNA, 20 bp, synthetic construct
  misc_feature 1..20: note = Synthetic Construct
  source 1..20: mol_type = other DNA
gtgttggtctcggccttgaa

SEQ ID NO: 42756 - DNA, 28 bp, synthetic construct
  misc_feature 1..28: note = Synthetic Construct
  source 1..28: mol_type = other DNA
gccagagttctaccctatctaatgaatc

SEQ ID NO: 42757 - DNA, 21 bp, synthetic construct
  misc_feature 1..21: note = Synthetic Construct
  source 1..21: mol_type = other DNA
accacaggcagatgagcaaag

SEQ ID NO: 42758 - DNA, 25 bp, synthetic construct
  misc_feature 1..25: note = Synthetic Construct
  source 1..25: mol_type = other DNA
gtggcatacacttgtagtcccatct

SEQ ID NO: 42759 - DNA, 24 bp, synthetic construct
  misc_feature 1..24: note = Synthetic Construct
  source 1..24: mol_type = other DNA
gcagctcttacttaggcctccaaa

SEQ ID NO: 42760 - DNA, 22 bp, synthetic construct
  misc_feature 1..22: note = Synthetic Construct
  source 1..22: mol_type = other DNA
tgcaacctctcttcctcctctt

SEQ ID NO: 42761 - DNA, 20 bp, synthetic construct
  misc_feature 1..20: note = Synthetic Construct
  source 1..20: mol_type = other DNA
gcaggttgaaggcagcagtt

SEQ ID NO: 42762 - DNA, 19 bp, synthetic construct
  misc_feature 1..19: note = Synthetic Construct
  source 1..19: mol_type = other DNA
aagcaacctcgggccacaa

SEQ ID NO: 42763 - DNA, 23 bp, synthetic construct
  misc_feature 1..23: note = Synthetic Construct
  source 1..23: mol_type = other DNA
tgtcctgtcctgaattgggaatg

SEQ ID NO: 42764 - DNA, 28 bp, synthetic construct
  misc_feature 1..28: note = Synthetic Construct
  source 1..28: mol_type = other DNA
ggatgtactttgtttcaaggcagcatag

SEQ ID NO: 42765 - DNA, 20 bp, synthetic construct
  misc_feature 1..20: note = Synthetic Construct
  source 1..20: mol_type = other DNA
atcccatgggtgtgcgatgt

SEQ ID NO: 42766 - DNA, 26 bp, synthetic construct
  misc_feature 1..26: note = Synthetic Construct
  source 1..26: mol_type = other DNA
tcttcatctctggagagctgtactat

SEQ ID NO: 42767 - DNA, 22 bp, synthetic construct
  misc_feature 1..22: note = Synthetic Construct
  source 1..22: mol_type = other DNA
cagcaatgtgcgaaacacaaac

SEQ ID NO: 42768 - DNA, 26 bp, synthetic construct
  misc_feature 1..26: note = Synthetic Construct
  source 1..26: mol_type = other DNA
gggaattttcctcaggggaatgaact

SEQ ID NO: 42769 - DNA, 20 bp, synthetic construct
  misc_feature 1..20: note = Synthetic Construct
  source 1..20: mol_type = other DNA
cacccaggaaggtgcagaaa

SEQ ID NO: 42770 - DNA, 21 bp, synthetic construct
  misc_feature 1..21: note = Synthetic Construct
  source 1..21: mol_type = other DNA
tgcacctccagtctcagctat

SEQ ID NO: 42771 - DNA, 21 bp, synthetic construct
  misc_feature 1..21: note = Synthetic Construct
  source 1..21: mol_type = other DNA
tcctgccctgtgctgttctca

SEQ ID NO: 42772 - DNA, 22 bp, synthetic construct
  misc_feature 1..22: note = Synthetic Construct
  source 1..22: mol_type = other DNA
ttgtgtacatgcccaaggctat

SEQ ID NO: 42773 - DNA, 22 bp, synthetic construct
  misc_feature 1..22: note = Synthetic Construct
  source 1..22: mol_type = other DNA
gcctggtattcaagggctccat

SEQ ID NO: 42774 - DNA, 24 bp, synthetic construct
  misc_feature 1..24: note = Synthetic Construct
  source 1..24: mol_type = other DNA
gatatattcgggcaggactgttgt

SEQ ID NO: 42775 - DNA, 25 bp, synthetic construct
  misc_feature 1..25: note = Synthetic Construct
  source 1..25: mol_type = other DNA
cccctctaaggtctttgagcagcta

SEQ ID NO: 42776 - DNA, 25 bp, synthetic construct
  misc_feature 1..25: note = Synthetic Construct
  source 1..25: mol_type = other DNA
ctgaagagggtgtagtcgtttgctt

SEQ ID NO: 42777 - DNA, 20 bp, synthetic construct
  misc_feature 1..20: note = Synthetic Construct
  source 1..20: mol_type = other DNA
ggccatcacagccagaaagt

SEQ ID NO: 42778 - DNA, 24 bp, synthetic construct
  misc_feature 1..24: note = Synthetic Construct
  source 1..24: mol_type = other DNA
cggaaaatgctagggaaggtgtct

SEQ ID NO: 42779 - DNA, 27 bp, synthetic construct
  misc_feature 1..27: note = Synthetic Construct
  source 1..27: mol_type = other DNA
actacgtgtaggtgaattgaacgatag

SEQ ID NO: 42780 - DNA, 24 bp, synthetic construct
  misc_feature 1..24: note = Synthetic Construct
  source 1..24: mol_type = other DNA
gaaaggagtgctacccagagatag

SEQ ID NO: 42781 - DNA, 20 bp, synthetic construct
  misc_feature 1..20: note = Synthetic Construct
  source 1..20: mol_type = other DNA
cagttctgcgctgaccaagt

SEQ ID NO: 42782 - DNA, 22 bp, synthetic construct
  misc_feature 1..22: note = Synthetic Construct
  source 1..22: mol_type = other DNA
cacctgcgggcctttatactca

SEQ ID NO: 42783 - DNA, 21 bp, synthetic construct
  misc_feature 1..21: note = Synthetic Construct
  source 1..21: mol_type = other DNA
gagacctttgagggcatgcaa

SEQ ID NO: 42784 - DNA, 23 bp, synthetic construct
  misc_feature 1..23: note = Synthetic Construct
  source 1..23: mol_type = other DNA
aggggaaaagcatcccatctttc

SEQ ID NO: 42785 - DNA, 26 bp, synthetic construct
  misc_feature 1..26: note = Synthetic Construct
  source 1..26: mol_type = other DNA
gggcaaaaggatcagaaaagtctaag

SEQ ID NO: 42786 - DNA, 22 bp, synthetic construct
  misc_feature 1..22: note = Synthetic Construct
  source 1..22: mol_type = other DNA
ggctgagtaggtttgtgacgat

SEQ ID NO: 42787 - DNA, 24 bp, synthetic construct
  misc_feature 1..24: note = Synthetic Construct
  source 1..24: mol_type = other DNA
ctgagatcttgtagcccagcctta

SEQ ID NO: 42788 - DNA, 22 bp, synthetic construct
  misc_feature 1..22: note = Synthetic Construct
  source 1..22: mol_type = other DNA
acgtaccctacaccagacaaca

SEQ ID NO: 42789 - DNA, 20 bp, synthetic construct
  misc_feature 1..20: note = Synthetic Construct
  source 1..20: mol_type = other DNA
gcagagttgtggcagcacta

SEQ ID NO: 42790 - DNA, 26 bp, synthetic construct
  misc_feature 1..26: note = Synthetic Construct
  source 1..26: mol_type = other DNA
gattatctggatgccccttaggtaac

SEQ ID NO: 42791 - DNA, 23 bp, synthetic construct
  misc_feature 1..23: note = Synthetic Construct
  source 1..23: mol_type = other DNA
gctttctatggctgatgctctct

SEQ ID NO: 42792 - DNA, 22 bp, synthetic construct
  misc_feature 1..22: note = Synthetic Construct
  source 1..22: mol_type = other DNA
ctgctgggtgtttgatcaccat

SEQ ID NO: 42793 - DNA, 21 bp, synthetic construct
  misc_feature 1..21: note = Synthetic Construct
  source 1..21: mol_type = other DNA
gccacatccacacctgctcaa

SEQ ID NO: 42794 - DNA, 22 bp, synthetic construct
  misc_feature 1..22: note = Synthetic Construct
  source 1..22: mol_type = other DNA
tgtgtagacagaggtgcctgtt

SEQ ID NO: 42795 - DNA, 25 bp, synthetic construct
  misc_feature 1..25: note = Synthetic Construct
  source 1..25: mol_type = other DNA
gccacctcaataccctttcgactct

SEQ ID NO: 42796 - DNA, 22 bp, synthetic construct
  misc_feature 1..22: note = Synthetic Construct
  source 1..22: mol_type = other DNA
tccacttcctcctcccagaaac

SEQ ID NO: 42797 - DNA, 24 bp, synthetic construct
  misc_feature 1..24: note = Synthetic Construct
  source 1..24: mol_type = other DNA
gctaaaaagttagcctgccaccat

SEQ ID NO: 42798 - DNA, 22 bp, synthetic construct
  misc_feature 1..22: note = Synthetic Construct
  source 1..22: mol_type = other DNA
cggcatcactgtgacaccaaag

SEQ ID NO: 42799 - DNA, 25 bp, synthetic construct
  misc_feature 1..25: note = Synthetic Construct
  source 1..25: mol_type = other DNA
cctttatgtaagcagggtcggaatg

SEQ ID NO: 42800 - DNA, 21 bp, synthetic construct
  misc_feature 1..21: note = Synthetic Construct
  source 1..21: mol_type = other DNA
gagatgggccagagagcattc

SEQ ID NO: 42801 - DNA, 22 bp, synthetic construct
  misc_feature 1..22: note = Synthetic Construct
  source 1..22: mol_type = other DNA
gtgtgtttccaggagccagact

SEQ ID NO: 42802 - DNA, 22 bp, synthetic construct
  misc_feature 1..22: note = Synthetic Construct
  source 1..22: mol_type = other DNA
actccgatgggtagaagccatt

SEQ ID NO: 42803 - DNA, 25 bp, synthetic construct
  misc_feature 1..25: note = Synthetic Construct
  source 1..25: mol_type = other DNA
gactaactactctgtgccagtcctt

SEQ ID NO: 42804 - DNA, 19 bp, synthetic construct
  misc_feature 1..19: note = Synthetic Construct
  source 1..19: mol_type = other DNA
agatggcaccagcctctgt

SEQ ID NO: 42805 - DNA, 23 bp, synthetic construct
  misc_feature 1..23: note = Synthetic Construct
  source 1..23: mol_type = other DNA
gacttggcaagctctgggatcat

SEQ ID NO: 42806 - DNA, 23 bp, synthetic construct
  misc_feature 1..23: note = Synthetic Construct
  source 1..23: mol_type = other DNA
ctcatgtagcatgacgcttctgt

SEQ ID NO: 42807 - DNA, 22 bp, synthetic construct
  misc_feature 1..22: note = Synthetic Construct
  source 1..22: mol_type = other DNA
agtggttcgcctctctgtactt

SEQ ID NO: 42808 - DNA, 20 bp, synthetic construct
  misc_feature 1..20: note = Synthetic Construct
  source 1..20: mol_type = other DNA
tcccttctcctcccctctca

SEQ ID NO: 42809 - DNA, 22 bp, synthetic construct
  misc_feature 1..22: note = Synthetic Construct
  source 1..22: mol_type = other DNA
agacagggtctcgtcacatttc

SEQ ID NO: 42810 - DNA, 24 bp, synthetic construct
  misc_feature 1..24: note = Synthetic Construct
  source 1..24: mol_type = other DNA
ggccttggttgattccagcagcat

SEQ ID NO: 42811 - DNA, 27 bp, synthetic construct
  misc_feature 1..27: note = Synthetic Construct
  source 1..27: mol_type = other DNA
gctaaataaggaaagggtactgggatt

SEQ ID NO: 42812 - DNA, 20 bp, synthetic construct
  misc_feature 1..20: note = Synthetic Construct
  source 1..20: mol_type = other DNA
tgggcatgaaccctgagcta

SEQ ID NO: 42813 - DNA, 22 bp, synthetic construct
  misc_feature 1..22: note = Synthetic Construct
  source 1..22: mol_type = other DNA
gatcttcggtccctcaggtttg

SEQ ID NO: 42814 - DNA, 23 bp, synthetic construct
  misc_feature 1..23: note = Synthetic Construct
  source 1..23: mol_type = other DNA
gggcttggatctttgtcgtcact

SEQ ID NO: 42815 - DNA, 20 bp, synthetic construct
  misc_feature 1..20: note = Synthetic Construct
  source 1..20: mol_type = other DNA
gtgggcgcttttgcttcttg

SEQ ID NO: 42816 - DNA, 23 bp, synthetic construct
  misc_feature 1..23: note = Synthetic Construct
  source 1..23: mol_type = other DNA
tccgggcagggagtagaagacta

SEQ ID NO: 42817 - DNA, 25 bp, synthetic construct
  misc_feature 1..25: note = Synthetic Construct
  source 1..25: mol_type = other DNA
gaaggctaaatgagctgggaatttg

SEQ ID NO: 42818 - DNA, 25 bp, synthetic construct
  misc_feature 1..25: note = Synthetic Construct
  source 1..25: mol_type = other DNA
tgagatgcttatcaccacaggtttc

SEQ ID NO: 42819 - DNA, 21 bp, synthetic construct
  misc_feature 1..21: note = Synthetic Construct
  source 1..21: mol_type = other DNA
acatgcaccctggaggtcaga

SEQ ID NO: 42820 - DNA, 19 bp, synthetic construct
  misc_feature 1..19: note = Synthetic Construct
  source 1..19: mol_type = other DNA
ggctgtggacgaggagtgt

SEQ ID NO: 42821 - DNA, 20 bp, synthetic construct
  misc_feature 1..20: note = Synthetic Construct
  source 1..20: mol_type = other DNA
tggcatcccttgcagtctgt

SEQ ID NO: 42822 - DNA, 20 bp, synthetic construct
  misc_feature 1..20: note = Synthetic Construct
  source 1..20: mol_type = other DNA
gcactccctctccaggtaca

SEQ ID NO: 42823 - DNA, 23 bp, synthetic construct
  misc_feature 1..23: note = Synthetic Construct
  source 1..23: mol_type = other DNA
gagttttcccggttaccgtcttc

SEQ ID NO: 42824 - DNA, 18 bp, synthetic construct
  misc_feature 1..18: note = Synthetic Construct
  source 1..18: mol_type = other DNA
tggtgaggagggcagcat

SEQ ID NO: 42825 - DNA, 25 bp, synthetic construct
  misc_feature 1..25: note = Synthetic Construct
  source 1..25: mol_type = other DNA
gtgttaagcatgttgccaaaagttg

SEQ ID NO: 42826 - DNA, 22 bp, synthetic construct
  misc_feature 1..22: note = Synthetic Construct
  source 1..22: mol_type = other DNA
tccattctcccacacgctaaag

SEQ ID NO: 42827 - DNA, 21 bp, synthetic construct
  misc_feature 1..21: note = Synthetic Construct
  source 1..21: mol_type = other DNA
ttctgttgccaagccctctac

SEQ ID NO: 42828 - DNA, 20 bp, synthetic construct
  misc_feature 1..20: note = Synthetic Construct
  source 1..20: mol_type = other DNA
tctgccctgcctttcaccaa

SEQ ID NO: 42829 - DNA, 21 bp, synthetic construct
  misc_feature 1..21: note = Synthetic Construct
  source 1..21: mol_type = other DNA
catcctggtttgccgatggtt

SEQ ID NO: 42830 - DNA, 18 bp, synthetic construct
  misc_feature 1..18: note = Synthetic Construct
  source 1..18: mol_type = other DNA
tgaggccactggggttga

SEQ ID NO: 42831 - DNA, 21 bp, synthetic construct
  misc_feature 1..21: note = Synthetic Construct
  source 1..21: mol_type = other DNA
aacttcccctcctgcccattg

SEQ ID NO: 42832 - DNA, 26 bp, synthetic construct
  misc_feature 1..26: note = Synthetic Construct
  source 1..26: mol_type = other DNA
cctactcacccatttatgaccacctt

SEQ ID NO: 42833 - DNA, 22 bp, synthetic construct
  misc_feature 1..22: note = Synthetic Construct
  source 1..22: mol_type = other DNA
gcaatggagtggagctgtttgt

SEQ ID NO: 42834 - DNA, 22 bp, synthetic construct
  misc_feature 1..22: note = Synthetic Construct
  source 1..22: mol_type = other DNA
tgagggtaaacaggggttctga

SEQ ID NO: 42835 - DNA, 22 bp, synthetic construct
  misc_feature 1..22: note = Synthetic Construct
  source 1..22: mol_type = other DNA
cagtaaccagaagccgctctac

SEQ ID NO: 42836 - DNA, 20 bp, synthetic construct
  misc_feature 1..20: note = Synthetic Construct
  source 1..20: mol_type = other DNA
gtgttgcctgtccagtctca

SEQ ID NO: 42837 - DNA, 25 bp, synthetic construct
  misc_feature 1..25: note = Synthetic Construct
  source 1..25: mol_type = other DNA
aaggatatgatgggtgcattgtagt

SEQ ID NO: 42838 - DNA, 21 bp, synthetic construct
  misc_feature 1..21: note = Synthetic Construct
  source 1..21: mol_type = other DNA
tgagctcagggaagcaagaga

SEQ ID NO: 42839 - DNA, 25 bp, synthetic construct
  misc_feature 1..25: note = Synthetic Construct
  source 1..25: mol_type = other DNA
accccaggttgagaataacttcttt

SEQ ID NO: 42840 - DNA, 23 bp, synthetic construct
  misc_feature 1..23: note = Synthetic Construct
  source 1..23: mol_type = other DNA
ggcttagctactttgagctgctt

SEQ ID NO: 42841 - DNA, 22 bp, synthetic construct
  misc_feature 1..22: note = Synthetic Construct
  source 1..22: mol_type = other DNA
ttctcctgcccttaccagtttc

SEQ ID NO: 42842 - DNA, 25 bp, synthetic construct
  misc_feature 1..25: note = Synthetic Construct
  source 1..25: mol_type = other DNA
gcgatgggacagttttcgagttatc

SEQ ID NO: 42843 - DNA, 22 bp, synthetic construct
  misc_feature 1..22: note = Synthetic Construct
  source 1..22: mol_type = other DNA
gaaggttcattcctccctgcaa

SEQ ID NO: 42844 - DNA, 25 bp, synthetic construct
  misc_feature 1..25: note = Synthetic Construct
  source 1..25: mol_type = other DNA
cccacacacttcttgcagctgtact

SEQ ID NO: 42845 - DNA, 23 bp, synthetic construct
  misc_feature 1..23: note = Synthetic Construct
  source 1..23: mol_type = other DNA
ccccatcactcactctggctcta

SEQ ID NO: 42846 - DNA, 18 bp, synthetic construct
  misc_feature 1..18: note = Synthetic Construct
  source 1..18: mol_type = other DNA
tgggcaacgtggggtcaa

SEQ ID NO: 42847 - DNA, 20 bp, synthetic construct
  misc_feature 1..20: note = Synthetic Construct
  source 1..20: mol_type = other DNA
ggtgcatggcatagcggaaa

SEQ ID NO: 42848 - DNA, 22 bp, synthetic construct
  misc_feature 1..22: note = Synthetic Construct
  source 1..22: mol_type = other DNA
gctgaggaaaggcagactgtga

SEQ ID NO: 42849 - DNA, 25 bp, synthetic construct
  misc_feature 1..25: note = Synthetic Construct
  source 1..25: mol_type = other DNA
gacacttggccattggaacctagaa

SEQ ID NO: 42850 - DNA, 22 bp, synthetic construct
  misc_feature 1..22: note = Synthetic Construct
  source 1..22: mol_type = other DNA
ttccagggccacactactccat

SEQ ID NO: 42851 - DNA, 26 bp, synthetic construct
  misc_feature 1..26: note = Synthetic Construct
  source 1..26: mol_type = other DNA
gtctctgtcatcacagtcacagaact

SEQ ID NO: 42852 - DNA, 22 bp, synthetic construct
  misc_feature 1..22: note = Synthetic Construct
  source 1..22: mol_type = other DNA
cacacctctcacccttggctat

SEQ ID NO: 42853 - DNA, 20 bp, synthetic construct
  misc_feature 1..20: note = Synthetic Construct
  source 1..20: mol_type = other DNA
tcccaggaagctgccttttg

SEQ ID NO: 42854 - DNA, 20 bp, synthetic construct
  misc_feature 1..20: note = Synthetic Construct
  source 1..20: mol_type = other DNA
cccttccagttccccacaga

SEQ ID NO: 42855 - DNA, 24 bp, synthetic construct
  misc_feature 1..24: note = Synthetic Construct
  source 1..24: mol_type = other DNA
ggaatcttgcagctcatcctgtca

SEQ ID NO: 42856 - DNA, 26 bp, synthetic construct
  misc_feature 1..26: note = Synthetic Construct
  source 1..26: mol_type = other DNA
gttagtgaagcagtcctgtgtaacat

SEQ ID NO: 42857 - DNA, 24 bp, synthetic construct
  misc_feature 1..24: note = Synthetic Construct
  source 1..24: mol_type = other DNA
gatggcatacgaccagaagaaaag

SEQ ID NO: 42858 - DNA, 24 bp, synthetic construct
  misc_feature 1..24: note = Synthetic Construct
  source 1..24: mol_type = other DNA
gacctaagggagcttgctttctct

SEQ ID NO: 42859 - DNA, 22 bp, synthetic construct
  misc_feature 1..22: note = Synthetic Construct
  source 1..22: mol_type = other DNA
cccagtggacaagtacctggtt

SEQ ID NO: 42860 - DNA, 19 bp, synthetic construct
  misc_feature 1..19: note = Synthetic Construct
  source 1..19: mol_type = other DNA
tgggccacagctcccagaa

SEQ ID NO: 42861 - DNA, 24 bp, synthetic construct
  misc_feature 1..24: note = Synthetic Construct
  source 1..24: mol_type = other DNA
gagacaggagccactggaattttg

SEQ ID NO: 42862 - DNA, 22 bp, synthetic construct
  misc_feature 1..22: note = Synthetic Construct
  source 1..22: mol_type = other DNA
gtactgtgtgtggctcatggta

SEQ ID NO: 42863 - DNA, 22 bp, synthetic construct
  misc_feature 1..22: note = Synthetic Construct
  source 1..22: mol_type = other DNA
aggtcccaagactgtggcttca

SEQ ID NO: 42864 - DNA, 23 bp, synthetic construct
  misc_feature 1..23: note = Synthetic Construct
  source 1..23: mol_type = other DNA
tcttgagaccaactctcctccaa

SEQ ID NO: 42865 - DNA, 21 bp, synthetic construct
  misc_feature 1..21: note = Synthetic Construct
  source 1..21: mol_type = other DNA
gcgctcagattacacgcgatt

SEQ ID NO: 42866 - DNA, 24 bp, synthetic construct
  misc_feature 1..24: note = Synthetic Construct
  source 1..24: mol_type = other DNA
acagctgtgaaggtattgaaggaa

SEQ ID NO: 42867 - DNA, 22 bp, synthetic construct
  misc_feature 1..22: note = Synthetic Construct
  source 1..22: mol_type = other DNA
ggagcaggaggaggaatcaatg

SEQ ID NO: 42868 - DNA, 22 bp, synthetic construct
  misc_feature 1..22: note = Synthetic Construct
  source 1..22: mol_type = other DNA
gcccaggtctgctagggttaaa

SEQ ID NO: 42869 - DNA, 21 bp, synthetic construct
  misc_feature 1..21: note = Synthetic Construct
  source 1..21: mol_type = other DNA
ccatcctcagcacagccatca

SEQ ID NO: 42870 - DNA, 25 bp, synthetic construct
  misc_feature 1..25: note = Synthetic Construct
  source 1..25: mol_type = other DNA
cagacaggttgagatgtgcctatac

SEQ ID NO: 42871 - DNA, 23 bp, synthetic construct
  misc_feature 1..23: note = Synthetic Construct
  source 1..23: mol_type = other DNA
acgacagtaatgggagggaatga

SEQ ID NO: 42872 - DNA, 24 bp, synthetic construct
  misc_feature 1..24: note = Synthetic Construct
  source 1..24: mol_type = other DNA
gggaatggctgatgttaagagaca

SEQ ID NO: 42873 - DNA, 20 bp, synthetic construct
  misc_feature 1..20: note = Synthetic Construct
  source 1..20: mol_type = other DNA
ttgggagaagcaggcacaga

SEQ ID NO: 42874 - DNA, 20 bp, synthetic construct
  misc_feature 1..20: note = Synthetic Construct
  source 1..20: mol_type = other DNA
acgctggagctggtgaaaca

SEQ ID NO: 42875 - DNA, 21 bp, synthetic construct
  misc_feature 1..21: note = Synthetic Construct
  source 1..21: mol_type = other DNA
gtggcaaaattgccctcttgt

SEQ ID NO: 42876 - DNA, 22 bp, synthetic construct
  misc_feature 1..22: note = Synthetic Construct
  source 1..22: mol_type = other DNA
ggaccacggatgatgcttttca

SEQ ID NO: 42877 - DNA, 25 bp, synthetic construct
  misc_feature 1..25: note = Synthetic Construct
  source 1..25: mol_type = other DNA
accacataaaaccaggaaggaatgt

SEQ ID NO: 42878 - DNA, 22 bp, synthetic construct
  misc_feature 1..22: note = Synthetic Construct
  source 1..22: mol_type = other DNA
gccctacaggagtggctttcat

SEQ ID NO: 42879 - DNA, 22 bp, synthetic construct
  misc_feature 1..22: note = Synthetic Construct
  source 1..22: mol_type = other DNA
ggcacaaggagtcctggcttta

SEQ ID NO: 42880 - DNA, 22 bp, synthetic construct
  misc_feature 1..22: note = Synthetic Construct
  source 1..22: mol_type = other DNA
ctctcatgcccaaactccactt

SEQ ID NO: 42881 - DNA, 20 bp, synthetic construct
  misc_feature 1..20: note = Synthetic Construct
  source 1..20: mol_type = other DNA
cgacagcacaggctccagtt

SEQ ID NO: 42882 - DNA, 20 bp, synthetic construct
  misc_feature 1..20: note = Synthetic Construct
  source 1..20: mol_type = other DNA
gcactgcggatcacttccat

SEQ ID NO: 42883 - DNA, 23 bp, synthetic construct
  misc_feature 1..23: note = Synthetic Construct
  source 1..23: mol_type = other DNA
cctgtgttttgcagctcctccta

SEQ ID NO: 42884 - DNA, 24 bp, synthetic construct
  misc_feature 1..24: note = Synthetic Construct
  source 1..24: mol_type = other DNA
ccctgcagataattctgcctgttg

SEQ ID NO: 42885 - DNA, 22 bp, synthetic construct
  misc_feature 1..22: note = Synthetic Construct
  source 1..22: mol_type = other DNA
cagccaaacataaagccgtgtt

SEQ ID NO: 42886 - DNA, 20 bp, synthetic construct
  misc_feature 1..20: note = Synthetic Construct
  source 1..20: mol_type = other DNA
tctttggccactgccctaca

SEQ ID NO: 42887 - DNA, 26 bp, synthetic construct
  misc_feature 1..26: note = Synthetic Construct
  source 1..26: mol_type = other DNA
ctgtcctacctcaggggtatatcaac

SEQ ID NO: 42888 - DNA, 26 bp, synthetic construct
  misc_feature 1..26: note = Synthetic Construct
  source 1..26: mol_type = other DNA
agacagtcttgaccactttctacttg

SEQ ID NO: 42889 - DNA, 20 bp, synthetic construct
  misc_feature 1..20: note = Synthetic Construct
  source 1..20: mol_type = other DNA
tggtcccgtttgccgagaca

SEQ ID NO: 42890 - DNA, 20 bp, synthetic construct
  misc_feature 1..20: note = Synthetic Construct
  source 1..20: mol_type = other DNA
ggcaaacagcctctctgaca

SEQ ID NO: 42891 - DNA, 25 bp, synthetic construct
  misc_feature 1..25: note = Synthetic Construct
  source 1..25: mol_type = other DNA
agcttcttcccagatttgaatcact

SEQ ID NO: 42892 - DNA, 19 bp, synthetic construct
  misc_feature 1..19: note = Synthetic Construct
  source 1..19: mol_type = other DNA
tgtcttgggcctcctgcaa

SEQ ID NO: 42893 - DNA, 24 bp, synthetic construct
  misc_feature 1..24: note = Synthetic Construct
  source 1..24: mol_type = other DNA
tcctttgaaattagctggccttgt

SEQ ID NO: 42894 - DNA, 20 bp, synthetic construct
  misc_feature 1..20: note = Synthetic Construct
  source 1..20: mol_type = other DNA
atggcaacagggaggcaaag

SEQ ID NO: 42895 - DNA, 22 bp, synthetic construct
  misc_feature 1..22: note = Synthetic Construct
  source 1..22: mol_type = other DNA
ggcagatttctccagcttgtca

SEQ ID NO: 42896 - DNA, 22 bp, synthetic construct
  misc_feature 1..22: note = Synthetic Construct
  source 1..22: mol_type = other DNA
gtggcagcagtagactcaccat

SEQ ID NO: 42897 - DNA, 24 bp, synthetic construct
  misc_feature 1..24: note = Synthetic Construct
  source 1..24: mol_type = other DNA
ccctactctgaatcaagcggcaaa

SEQ ID NO: 42898 - DNA, 25 bp, synthetic construct
  misc_feature 1..25: note = Synthetic Construct
  source 1..25: mol_type = other DNA
cagcagcccattttaacttccattg

SEQ ID NO: 42899 - DNA, 20 bp, synthetic construct
  misc_feature 1..20: note = Synthetic Construct
  source 1..20: mol_type = other DNA
tcaggcaacctcccaccatt

SEQ ID NO: 42900 - DNA, 22 bp, synthetic construct
  misc_feature 1..22: note = Synthetic Construct
  source 1..22: mol_type = other DNA
catcatcctccctgggcttgta

SEQ ID NO: 42901 - DNA, 22 bp, synthetic construct
  misc_feature 1..22: note = Synthetic Construct
  source 1..22: mol_type = other DNA
ggtgttgggtggctgaaagaca

SEQ ID NO: 42902 - DNA, 20 bp, synthetic construct
  misc_feature 1..20: note = Synthetic Construct
  source 1..20: mol_type = other DNA
ctttgtggcttggggagtga

SEQ ID NO: 42903 - DNA, 20 bp, synthetic construct
  misc_feature 1..20: note = Synthetic Construct
  source 1..20: mol_type = other DNA
ggaaggcactggctgctaat

SEQ ID NO: 42904 - DNA, 21 bp, synthetic construct
  misc_feature 1..21: note = Synthetic Construct
  source 1..21: mol_type = other DNA
tggaccactgctgccactact

SEQ ID NO: 42905 - DNA, 20 bp, synthetic construct
  misc_feature 1..20: note = Synthetic Construct
  source 1..20: mol_type = other DNA
gcacttgctcgtctccttct

SEQ ID NO: 42906 - DNA, 21 bp, synthetic construct
  misc_feature 1..21: note = Synthetic Construct
  source 1..21: mol_type = other DNA
ggtctcaggagcctggtggta

SEQ ID NO: 42907 - DNA, 19 bp, synthetic construct
  misc_feature 1..19: note = Synthetic Construct
  source 1..19: mol_type = other DNA
agagggcaggcgggaatca

SEQ ID NO: 42908 - DNA, 19 bp, synthetic construct
  misc_feature 1..19: note = Synthetic Construct
  source 1..19: mol_type = other DNA
tctgccttcagggccagta

SEQ ID NO: 42909 - DNA, 25 bp, synthetic construct
  misc_feature 1..25: note = Synthetic Construct
  source 1..25: mol_type = other DNA
cctgcatagtggttaggagggtgta

SEQ ID NO: 42910 - DNA, 22 bp, synthetic construct
  misc_feature 1..22: note = Synthetic Construct
  source 1..22: mol_type = other DNA
tggagatcctggctgtcacctt

SEQ ID NO: 42911 - DNA, 19 bp, synthetic construct
  misc_feature 1..19: note = Synthetic Construct
  source 1..19: mol_type = other DNA
ccaccaggggtcagacact

SEQ ID NO: 42912 - DNA, 21 bp, synthetic construct
  misc_feature 1..21: note = Synthetic Construct
  source 1..21: mol_type = other DNA
tggaaaaagggtctgcgtgaa

SEQ ID NO: 42913 - DNA, 25 bp, synthetic construct
  misc_feature 1..25: note = Synthetic Construct
  source 1..25: mol_type = other DNA
ccctgacagacaaccgtcttccttt

SEQ ID NO: 42914 - DNA, 20 bp, synthetic construct
  misc_feature 1..20: note = Synthetic Construct
  source 1..20: mol_type = other DNA
tctgctttcgctgcttcgtt

SEQ ID NO: 42915 - DNA, 20 bp, synthetic construct
  misc_feature 1..20: note = Synthetic Construct
  source 1..20: mol_type = other DNA
tgctgtgctgcccctggtta

SEQ ID NO: 42916 - DNA, 22 bp, synthetic construct
  misc_feature 1..22: note = Synthetic Construct
  source 1..22: mol_type = other DNA
gggtgatggatctgctgtgact

SEQ ID NO: 42917 - DNA, 21 bp, synthetic construct
  misc_feature 1..21: note = Synthetic Construct
  source 1..21: mol_type = other DNA
tggctgaatgggcaggtggat

SEQ ID NO: 42918 - DNA, 22 bp, synthetic construct
  misc_feature 1..22: note = Synthetic Construct
  source 1..22: mol_type = other DNA
gtccccactgcaccttacatca

SEQ ID NO: 42919 - DNA, 20 bp, synthetic construct
  misc_feature 1..20: note = Synthetic Construct
  source 1..20: mol_type = other DNA
gctgccagaggagtgtgtga

SEQ ID NO: 42920 - DNA, 20 bp, synthetic construct
  misc_feature 1..20: note = Synthetic Construct
  source 1..20: mol_type = other DNA
cacggcaaaggccagagttt

SEQ ID NO: 42921 - DNA, 23 bp, synthetic construct
  misc_feature 1..23: note = Synthetic Construct
  source 1..23: mol_type = other DNA
ggtctgcatactgcagttacctt

SEQ ID NO: 42922 - DNA, 19 bp, synthetic construct
  misc_feature 1..19: note = Synthetic Construct
  source 1..19: mol_type = other DNA
gctgacagcaggggctact

SEQ ID NO: 42923 - DNA, 23 bp, synthetic construct
  misc_feature 1..23: note = Synthetic Construct
  source 1..23: mol_type = other DNA
ctctcagggagcttggtttttga

SEQ ID NO: 42924 - DNA, 19 bp, synthetic construct
  misc_feature 1..19: note = Synthetic Construct
  source 1..19: mol_type = other DNA
aggccaaaggacgggtgaa

SEQ ID NO: 42925 - DNA, 23 bp, synthetic construct
  misc_feature 1..23: note = Synthetic Construct
  source 1..23: mol_type = other DNA
gacctgaatagcacacacagact

SEQ ID NO: 42926 - DNA, 25 bp, synthetic construct
  misc_feature 1..25: note = Synthetic Construct
  source 1..25: mol_type = other DNA
agtcttaaactaggtgacactgcaa

SEQ ID NO: 42927 - DNA, 24 bp, synthetic construct
  misc_feature 1..24: note = Synthetic Construct
  source 1..24: mol_type = other DNA
tcaggctgatagaaaatcctgctt

SEQ ID NO: 42928 - DNA, 19 bp, synthetic construct
  misc_feature 1..19: note = Synthetic Construct
  source 1..19: mol_type = other DNA
accaggtcggaggcgatga

SEQ ID NO: 42929 - DNA, 25 bp, synthetic construct
  misc_feature 1..25: note = Synthetic Construct
  source 1..25: mol_type = other DNA
ccagaaaggggtttctcagggagtt

SEQ ID NO: 42930 - DNA, 22 bp, synthetic construct
  misc_feature 1..22: note = Synthetic Construct
  source 1..22: mol_type = other DNA
ttccagctcaggtcagcacttg

SEQ ID NO: 42931 - DNA, 22 bp, synthetic construct
  misc_feature 1..22: note = Synthetic Construct
  source 1..22: mol_type = other DNA
ctgacccagagggttgaacagt

SEQ ID NO: 42932 - DNA, 27 bp, synthetic construct
  misc_feature 1..27: note = Synthetic Construct
  source 1..27: mol_type = other DNA
caactacttctaaccaccatcactact

SEQ ID NO: 42933 - DNA, 25 bp, synthetic construct
  misc_feature 1..25: note = Synthetic Construct
  source 1..25: mol_type = other DNA
ccacacaacaaggattccagccata

SEQ ID NO: 42934 - DNA, 22 bp, synthetic construct
  misc_feature 1..22: note = Synthetic Construct
  source 1..22: mol_type = other DNA
gtcccctattgctggacacctt

SEQ ID NO: 42935 - DNA, 21 bp, synthetic construct
  misc_feature 1..21: note = Synthetic Construct
  source 1..21: mol_type = other DNA
aaggagtgggatggcgctaga

SEQ ID NO: 42936 - DNA, 20 bp, synthetic construct
  misc_feature 1..20: note = Synthetic Construct
  source 1..20: mol_type = other DNA
tgccggaaaccaccaacctt

SEQ ID NO: 42937 - DNA, 26 bp, synthetic construct
  misc_feature 1..26: note = Synthetic Construct
  source 1..26: mol_type = other DNA
ccatcatcaatcaccatgtcctgata

SEQ ID NO: 42938 - DNA, 20 bp, synthetic construct
  misc_feature 1..20: note = Synthetic Construct
  source 1..20: mol_type = other DNA
tgtgcacttgccaggggttt

SEQ ID NO: 42939 - DNA, 21 bp, synthetic construct
  misc_feature 1..21: note = Synthetic Construct
  source 1..21: mol_type = other DNA
gcaaaggcagctggcaatttt

SEQ ID NO: 42940 - DNA, 20 bp, synthetic construct
  misc_feature 1..20: note = Synthetic Construct
  source 1..20: mol_type = other DNA
tgctacagggcagccaacat

SEQ ID NO: 42941 - DNA, 19 bp, synthetic construct
  misc_feature 1..19: note = Synthetic Construct
  source 1..19: mol_type = other DNA
gactgtgccggttgagaca

SEQ ID NO: 42942 - DNA, 22 bp, synthetic construct
  misc_feature 1..22: note = Synthetic Construct
  source 1..22: mol_type = other DNA
tgctcccctccctcaaatggat

SEQ ID NO: 42943 - DNA, 22 bp, synthetic construct
  misc_feature 1..22: note = Synthetic Construct
  source 1..22: mol_type = other DNA
tgggaggggcatatgggacaat

SEQ ID NO: 42944 - DNA, 22 bp, synthetic construct
  misc_feature 1..22: note = Synthetic Construct
  source 1..22: mol_type = other DNA
ccatctgatcccagcctgcttt

SEQ ID NO: 42945 - DNA, 22 bp, synthetic construct
  misc_feature 1..22: note = Synthetic Construct
  source 1..22: mol_type = other DNA
cccgacaacagtggagcagaaa

SEQ ID NO: 42946 - DNA, 18 bp, synthetic construct
  misc_feature 1..18: note = Synthetic Construct
  source 1..18: mol_type = other DNA
tggtttggggcgcattga

SEQ ID NO: 42947 - DNA, 23 bp, synthetic construct
  misc_feature 1..23: note = Synthetic Construct
  source 1..23: mol_type = other DNA
atgcagagggagttgcaataaga

SEQ ID NO: 42948 - DNA, 22 bp, synthetic construct
  misc_feature 1..22: note = Synthetic Construct
  source 1..22: mol_type = other DNA
ctgtccagaacccattccatga

SEQ ID NO: 42949 - DNA, 24 bp, synthetic construct
  misc_feature 1..24: note = Synthetic Construct
  source 1..24: mol_type = other DNA
tggatgactgttgtaacccacttg

SEQ ID NO: 42950 - DNA, 22 bp, synthetic construct
  misc_feature 1..22: note = Synthetic Construct
  source 1..22: mol_type = other DNA
tcctggggtccagaggtaactt

SEQ ID NO: 42951 - DNA, 24 bp, synthetic construct
  misc_feature 1..24: note = Synthetic Construct
  source 1..24: mol_type = other DNA
aggtagccttccaaagtgagaaaa

SEQ ID NO: 42952 - DNA, 23 bp, synthetic construct
  misc_feature 1..23: note = Synthetic Construct
  source 1..23: mol_type = other DNA
aggactcagttacctggtgtttg

SEQ ID NO: 42953 - DNA, 20 bp, synthetic construct
  misc_feature 1..20: note = Synthetic Construct
  source 1..20: mol_type = other DNA
cattggcccatggactgaca

SEQ ID NO: 42954 - DNA, 19 bp, synthetic construct
  misc_feature 1..19: note = Synthetic Construct
  source 1..19: mol_type = other DNA
cccaggctcgtacgggtaa

SEQ ID NO: 42955 - DNA, 20 bp, synthetic construct
  misc_feature 1..20: note = Synthetic Construct
  source 1..20: mol_type = other DNA
gcacatgctgggtggctttg

SEQ ID NO: 42956 - DNA, 22 bp, synthetic construct
  misc_feature 1..22: note = Synthetic Construct
  source 1..22: mol_type = other DNA
gggaggatggcattcacagcaa

SEQ ID NO: 42957 - DNA, 20 bp, synthetic construct
  misc_feature 1..20: note = Synthetic Construct
  source 1..20: mol_type = other DNA
tgaggccaacagtgccagaa

SEQ ID NO: 42958 - DNA, 23 bp, synthetic construct
  misc_feature 1..23: note = Synthetic Construct
  source 1..23: mol_type = other DNA
gtcacgcaagagactgttaggtt

SEQ ID NO: 42959 - DNA, 24 bp, synthetic construct
  misc_feature 1..24: note = Synthetic Construct
  source 1..24: mol_type = other DNA
ggggagctaaaaggcacatgtttg

SEQ ID NO: 42960 - DNA, 21 bp, synthetic construct
  misc_feature 1..21: note = Synthetic Construct
  source 1..21: mol_type = other DNA
acagcccctaccagggtttac

SEQ ID NO: 42961 - DNA, 19 bp, synthetic construct
  misc_feature 1..19: note = Synthetic Construct
  source 1..19: mol_type = other DNA
cagtggaccgactgctgtt

SEQ ID NO: 42962 - DNA, 24 bp, synthetic construct
  misc_feature 1..24: note = Synthetic Construct
  source 1..24: mol_type = other DNA
gctctaatcctctgtggctgaaca

SEQ ID NO: 42963 - DNA, 25 bp, synthetic construct
  misc_feature 1..25: note = Synthetic Construct
  source 1..25: mol_type = other DNA
gcttgaatcaatgggcatctctgaa

SEQ ID NO: 42964 - DNA, 24 bp, synthetic construct
  misc_feature 1..24: note = Synthetic Construct
  source 1..24: mol_type = other DNA
cattgtctgcacaggtaaaccaat

SEQ ID NO: 42965 - DNA, 21 bp, synthetic construct
  misc_feature 1..21: note = Synthetic Construct
  source 1..21: mol_type = other DNA
agacccagccacatgtctact

SEQ ID NO: 42966 - DNA, 21 bp, synthetic construct
  misc_feature 1..21: note = Synthetic Construct
  source 1..21: mol_type = other DNA
ttggttgcaggaggggaccaa

SEQ ID NO: 42967 - DNA, 24 bp, synthetic construct
  misc_feature 1..24: note = Synthetic Construct
  source 1..24: mol_type = other DNA
gcgagcttagagcagagaggaact

SEQ ID NO: 42968 - DNA, 22 bp, synthetic construct
  misc_feature 1..22: note = Synthetic Construct
  source 1..22: mol_type = other DNA
agactgggagagaaagcaggaa

SEQ ID NO: 42969 - DNA, 26 bp, synthetic construct
  misc_feature 1..26: note = Synthetic Construct
  source 1..26: mol_type = other DNA
gcaaagcagactacactcactgtcat

SEQ ID NO: 42970 - DNA, 20 bp, synthetic construct
  misc_feature 1..20: note = Synthetic Construct
  source 1..20: mol_type = other DNA
ccacatgctccacactgctt

SEQ ID NO: 42971 - DNA, 22 bp, synthetic construct
  misc_feature 1..22: note = Synthetic Construct
  source 1..22: mol_type = other DNA
cctttcacctcagcccaaccta

SEQ ID NO: 42972 - DNA, 26 bp, synthetic construct
  misc_feature 1..26: note = Synthetic Construct
  source 1..26: mol_type = other DNA
cctgcaccataccactgtcctcatag

SEQ ID NO: 42973 - DNA, 28 bp, synthetic construct
  misc_feature 1..28: note = Synthetic Construct
  source 1..28: mol_type = other DNA
ggaccagctataacttgatggactgaac

SEQ ID NO: 42974 - DNA, 23 bp, synthetic construct
  misc_feature 1..23: note = Synthetic Construct
  source 1..23: mol_type = other DNA
gcagtatgtcttcgctggtcaac

SEQ ID NO: 42975 - DNA, 22 bp, synthetic construct
  misc_feature 1..22: note = Synthetic Construct
  source 1..22: mol_type = other DNA
aagcaaggtggaagcttctgat

SEQ ID NO: 42976 - DNA, 23 bp, synthetic construct
  misc_feature 1..23: note = Synthetic Construct
  source 1..23: mol_type = other DNA
gaatttctcacgtctgcctgtct

SEQ ID NO: 42977 - DNA, 20 bp, synthetic construct
  misc_feature 1..20: note = Synthetic Construct
  source 1..20: mol_type = other DNA
aaagcacctgcggtctgtct

SEQ ID NO: 42978 - DNA, 23 bp, synthetic construct
  misc_feature 1..23: note = Synthetic Construct
  source 1..23: mol_type = other DNA
ggctcacctgtgagtaagtgtct

SEQ ID NO: 42979 - DNA, 20 bp, synthetic construct
  misc_feature 1..20: note = Synthetic Construct
  source 1..20: mol_type = other DNA
tgcgccaactggggtaccat

SEQ ID NO: 42980 - DNA, 22 bp, synthetic construct
  misc_feature 1..22: note = Synthetic Construct
  source 1..22: mol_type = other DNA
ggcgaccaagccttgcttatga

SEQ ID NO: 42981 - DNA, 20 bp, synthetic construct
  misc_feature 1..20: note = Synthetic Construct
  source 1..20: mol_type = other DNA
atgcggcagggacccgattc

SEQ ID NO: 42982 - DNA, 19 bp, synthetic construct
  misc_feature 1..19: note = Synthetic Construct
  source 1..19: mol_type = other DNA
ccctgagtggtgcctccat

SEQ ID NO: 42983 - DNA, 26 bp, synthetic construct
  misc_feature 1..26: note = Synthetic Construct
  source 1..26: mol_type = other DNA
cactcccatcctacttgaaacaaatc

SEQ ID NO: 42984 - DNA, 24 bp, synthetic construct
  misc_feature 1..24: note = Synthetic Construct
  source 1..24: mol_type = other DNA
ggcagagaacagagaactgtggat

SEQ ID NO: 42985 - DNA, 26 bp, synthetic construct
  misc_feature 1..26: note = Synthetic Construct
  source 1..26: mol_type = other DNA
gggcaggtaggtaaaaggatcagtct

SEQ ID NO: 42986 - DNA, 23 bp, synthetic construct
  misc_feature 1..23: note = Synthetic Construct
  source 1..23: mol_type = other DNA
tgctctgaatgaaacccaactct

SEQ ID NO: 42987 - DNA, 26 bp, synthetic construct
  misc_feature 1..26: note = Synthetic Construct
  source 1..26: mol_type = other DNA
caaggtacactttctcccataagaca

SEQ ID NO: 42988 - DNA, 25 bp, synthetic construct
  misc_feature 1..25: note = Synthetic Construct
  source 1..25: mol_type = other DNA
tgagtctaatttagcgtggggtaac

SEQ ID NO: 42989 - DNA, 22 bp, synthetic construct
  misc_feature 1..22: note = Synthetic Construct
  source 1..22: mol_type = other DNA
aggaagccgaccaaaggcaatc

SEQ ID NO: 42990 - DNA, 21 bp, synthetic construct
  misc_feature 1..21: note = Synthetic Construct
  source 1..21: mol_type = other DNA
ccccgagaggagcagagttta

SEQ ID NO: 42991 - DNA, 24 bp, synthetic construct
  misc_feature 1..24: note = Synthetic Construct
  source 1..24: mol_type = other DNA
actcaaccactgccataattgcta

SEQ ID NO: 42992 - DNA, 24 bp, synthetic construct
  misc_feature 1..24: note = Synthetic Construct
  source 1..24: mol_type = other DNA
ctgatccagagtaggtgcacaatc

SEQ ID NO: 42993 - DNA, 20 bp, synthetic construct
  misc_feature 1..20: note = Synthetic Construct
  source 1..20: mol_type = other DNA
agggtggcctcctgtgtcta

SEQ ID NO: 42994 - DNA, 23 bp, synthetic construct
  misc_feature 1..23: note = Synthetic Construct
  source 1..23: mol_type = other DNA
gacaacagggaaccctcatctca

SEQ ID NO: 42995 - DNA, 22 bp, synthetic construct
  misc_feature 1..22: note = Synthetic Construct
  source 1..22: mol_type = other DNA
ggcttgccagagaaggaaggat

SEQ ID NO: 42996 - DNA, 27 bp, synthetic construct
  misc_feature 1..27: note = Synthetic Construct
  source 1..27: mol_type = other DNA
ctggtttcaaatgttccaaggcctatt

SEQ ID NO: 42997 - DNA, 20 bp, synthetic construct
  misc_feature 1..20: note = Synthetic Construct
  source 1..20: mol_type = other DNA
acccgccctctcttcctttg

SEQ ID NO: 42998 - DNA, 22 bp, synthetic construct
  misc_feature 1..22: note = Synthetic Construct
  source 1..22: mol_type = other DNA
ggctctgtgggatgacagcata

SEQ ID NO: 42999 - DNA, 20 bp, synthetic construct
  misc_feature 1..20: note = Synthetic Construct
  source 1..20: mol_type = other DNA
ttggctgtcaccacccattg

SEQ ID NO: 43000 - DNA, 22 bp, synthetic construct
  misc_feature 1..22: note = Synthetic Construct
  source 1..22: mol_type = other DNA
gctcagcattccaccccattct

SEQ ID NO: 43001 - DNA, 26 bp, synthetic construct
  misc_feature 1..26: note = Synthetic Construct
  source 1..26: mol_type = other DNA
ccaagactcctgcttattttctccaa

SEQ ID NO: 43002 - DNA, 25 bp, synthetic construct
  misc_feature 1..25: note = Synthetic Construct
  source 1..25: mol_type = other DNA
cactagtggacacctaagtcagctt

SEQ ID NO: 43003 - DNA, 21 bp, synthetic construct
  misc_feature 1..21: note = Synthetic Construct
  source 1..21: mol_type = other DNA
cccgtgcacatgtgttgtttg

SEQ ID NO: 43004 - DNA, 21 bp, synthetic construct
  misc_feature 1..21: note = Synthetic Construct
  source 1..21: mol_type = other DNA
cgttcaccacacatgccaatg

SEQ ID NO: 43005 - DNA, 20 bp, synthetic construct
  misc_feature 1..20: note = Synthetic Construct
  source 1..20: mol_type = other DNA
ccagtggctgaactgtgcat

SEQ ID NO: 43006 - DNA, 24 bp, synthetic construct
  misc_feature 1..24: note = Synthetic Construct
  source 1..24: mol_type = other DNA
gggagtttacgtgtcttgtgtttg

SEQ ID NO: 43007 - DNA, 22 bp, synthetic construct
  misc_feature 1..22: note = Synthetic Construct
  source 1..22: mol_type = other DNA
ctgctcatcaagcactcgacaa

SEQ ID NO: 43008 - DNA, 20 bp, synthetic construct
  misc_feature 1..20: note = Synthetic Construct
  source 1..20: mol_type = other DNA
gcctgaaatgcagccaccat

SEQ ID NO: 43009 - DNA, 23 bp, synthetic construct
  misc_feature 1..23: note = Synthetic Construct
  source 1..23: mol_type = other DNA
ttctgtcagcttggctgatgtta

SEQ ID NO: 43010 - DNA, 26 bp, synthetic construct
  misc_feature 1..26: note = Synthetic Construct
  source 1..26: mol_type = other DNA
ctggttcttaggtttagttcctggat

SEQ ID NO: 43011 - DNA, 24 bp, synthetic construct
  misc_feature 1..24: note = Synthetic Construct
  source 1..24: mol_type = other DNA
cacgaagcaaagactagcatctca

SEQ ID NO: 43012 - DNA, 30 bp, synthetic construct
  misc_feature 1..30: note = Synthetic Construct
  source 1..30: mol_type = other DNA
ccacgttaaaactagagaagacatgggtta

SEQ ID NO: 43013 - DNA, 22 bp, synthetic construct
  misc_feature 1..22: note = Synthetic Construct
  source 1..22: mol_type = other DNA
gctcctgtcttgcagtttctct

SEQ ID NO: 43014 - DNA, 22 bp, synthetic construct
  misc_feature 1..22: note = Synthetic Construct
  source 1..22: mol_type = other DNA
cctgggcttcctcccacaattt

SEQ ID NO: 43015 - DNA, 25 bp, synthetic construct
  misc_feature 1..25: note = Synthetic Construct
  source 1..25: mol_type = other DNA
ggtgctaaatttttcccgtcacaag

SEQ ID NO: 43016 - DNA, 21 bp, synthetic construct
  misc_feature 1..21: note = Synthetic Construct
  source 1..21: mol_type = other DNA
tgttccccatcccacatgaag

SEQ ID NO: 43017 - DNA, 27 bp, synthetic construct
  misc_feature 1..27: note = Synthetic Construct
  source 1..27: mol_type = other DNA
ccaaagtcaaaagggtgagaaggagtt

SEQ ID NO: 43018 - DNA, 21 bp, synthetic construct
  misc_feature 1..21: note = Synthetic Construct
  source 1..21: mol_type = other DNA
tgtctgtccacttcccacact

SEQ ID NO: 43019 - DNA, 21 bp, synthetic construct
  misc_feature 1..21: note = Synthetic Construct
  source 1..21: mol_type = other DNA
gatctgcacgtccacctacat

SEQ ID NO: 43020 - DNA, 22 bp, synthetic construct
  misc_feature 1..22: note = Synthetic Construct
  source 1..22: mol_type = other DNA
gctgcagccagaggttttcaga

SEQ ID NO: 43021 - DNA, 24 bp, synthetic construct
  misc_feature 1..24: note = Synthetic Construct
  source 1..24: mol_type = other DNA
cctcaagcatgactccaaagttga

SEQ ID NO: 43022 - DNA, 28 bp, synthetic construct
  misc_feature 1..28: note = Synthetic Construct
  source 1..28: mol_type = other DNA
cttctagagtgtggagaatctaggtaca

SEQ ID NO: 43023 - DNA, 19 bp, synthetic construct
  misc_feature 1..19: note = Synthetic Construct
  source 1..19: mol_type = other DNA
ctggcaggcctgactttgt

SEQ ID NO: 43024 - DNA, 25 bp, synthetic construct
  misc_feature 1..25: note = Synthetic Construct
  source 1..25: mol_type = other DNA
cctggttctcagtctgtggctttag

SEQ ID NO: 43025 - DNA, 22 bp, synthetic construct
  misc_feature 1..22: note = Synthetic Construct
  source 1..22: mol_type = other DNA
aggaaggggatgaggaagagtt

SEQ ID NO: 43026 - DNA, 24 bp, synthetic construct
  misc_feature 1..24: note = Synthetic Construct
  source 1..24: mol_type = other DNA
cctcaaagggtaatcccagcatga

SEQ ID NO: 43027 - DNA, 23 bp, synthetic construct
  misc_feature 1..23: note = Synthetic Construct
  source 1..23: mol_type = other DNA
ttaaaactggacagccactcctt

SEQ ID NO: 43028 - DNA, 20 bp, synthetic construct
  misc_feature 1..20: note = Synthetic Construct
  source 1..20: mol_type = other DNA
cccatgggtgggtcatgtct

SEQ ID NO: 43029 - DNA, 22 bp, synthetic construct
  misc_feature 1..22: note = Synthetic Construct
  source 1..22: mol_type = other DNA
ggttcctttccaggagtgtcaa

SEQ ID NO: 43030 - DNA, 25 bp, synthetic construct
  misc_feature 1..25: note = Synthetic Construct
  source 1..25: mol_type = other DNA
gctcttgaaactcctctccctcatt

SEQ ID NO: 43031 - DNA, 22 bp, synthetic construct
  misc_feature 1..22: note = Synthetic Construct
  source 1..22: mol_type = other DNA
ggcagtgaacgcatgtccctaa

SEQ ID NO: 43032 - DNA, 21 bp, synthetic construct
  misc_feature 1..21: note = Synthetic Construct
  source 1..21: mol_type = other DNA
acctctctgcacagccagcat

SEQ ID NO: 43033 - DNA, 26 bp, synthetic construct
  misc_feature 1..26: note = Synthetic Construct
  source 1..26: mol_type = other DNA
cacacttgaattcgttgcctacagtt

SEQ ID NO: 43034 - DNA, 25 bp, synthetic construct
  misc_feature 1..25: note = Synthetic Construct
  source 1..25: mol_type = other DNA
ccatagaagtccgagaatgtcactt

SEQ ID NO: 43035 - DNA, 25 bp, synthetic construct
  misc_feature 1..25: note = Synthetic Construct
  source 1..25: mol_type = other DNA
cccaaatagctcaagccaagtctgt

SEQ ID NO: 43036 - DNA, 22 bp, synthetic construct
  misc_feature 1..22: note = Synthetic Construct
  source 1..22: mol_type = other DNA
ccatcttggctgcccgattctt

SEQ ID NO: 43037 - DNA, 19 bp, synthetic construct
  misc_feature 1..19: note = Synthetic Construct
  source 1..19: mol_type = other DNA
aggcaccggaagccttaac

SEQ ID NO: 43038 - DNA, 24 bp, synthetic construct
  misc_feature 1..24: note = Synthetic Construct
  source 1..24: mol_type = other DNA
cccatgagcttaacagccctggaa

SEQ ID NO: 43039 - DNA, 22 bp, synthetic construct
  misc_feature 1..22: note = Synthetic Construct
  source 1..22: mol_type = other DNA
ggttttagccgaagcccacaac

SEQ ID NO: 43040 - DNA, 26 bp, synthetic construct
  misc_feature 1..26: note = Synthetic Construct
  source 1..26: mol_type = other DNA
gaccagaagctgtatttaccccagat

SEQ ID NO: 43041 - DNA, 21 bp, synthetic construct
  misc_feature 1..21: note = Synthetic Construct
  source 1..21: mol_type = other DNA
atggagggcagggctggagtt

SEQ ID NO: 43042 - DNA, 26 bp, synthetic construct
  misc_feature 1..26: note = Synthetic Construct
  source 1..26: mol_type = other DNA
cttctagcattcccactatcagaaca

SEQ ID NO: 43043 - DNA, 20 bp, synthetic construct
  misc_feature 1..20: note = Synthetic Construct
  source 1..20: mol_type = other DNA
ctgtggagcttgtggagctt

SEQ ID NO: 43044 - DNA, 24 bp, synthetic construct
  misc_feature 1..24: note = Synthetic Construct
  source 1..24: mol_type = other DNA
gcctaagcaggttcctaccccata

SEQ ID NO: 43045 - DNA, 25 bp, synthetic construct
  misc_feature 1..25: note = Synthetic Construct
  source 1..25: mol_type = other DNA
gtcctagccttactgaatggtgaac

SEQ ID NO: 43046 - DNA, 29 bp, synthetic construct
  misc_feature 1..29: note = Synthetic Construct
  source 1..29: mol_type = other DNA
gagtcatagaattttcagccttcgacatc

SEQ ID NO: 43047 - DNA, 22 bp, synthetic construct
  misc_feature 1..22: note = Synthetic Construct
  source 1..22: mol_type = other DNA
tgcctaggaaagggctcacaga

SEQ ID NO: 43048 - DNA, 25 bp, synthetic construct
  misc_feature 1..25: note = Synthetic Construct
  source 1..25: mol_type = other DNA
aacagaagagggctatttccattgt

SEQ ID NO: 43049 - DNA, 27 bp, synthetic construct
  misc_feature 1..27: note = Synthetic Construct
  source 1..27: mol_type = other DNA
ggagcttaacatcttggtatggtcaag

SEQ ID NO: 43050 - DNA, 24 bp, synthetic construct
  misc_feature 1..24: note = Synthetic Construct
  source 1..24: mol_type = other DNA
gcattgttcaaggctgagactcta

SEQ ID NO: 43051 - DNA, 26 bp, synthetic construct
  misc_feature 1..26: note = Synthetic Construct
  source 1..26: mol_type = other DNA
gcagtaatttgcatcgaaagggatgt

SEQ ID NO: 43052 - DNA, 22 bp, synthetic construct
  misc_feature 1..22: note = Synthetic Construct
  source 1..22: mol_type = other DNA
agcagcctccccagaggtaata

SEQ ID NO: 43053 - DNA, 25 bp, synthetic construct
  misc_feature 1..25: note = Synthetic Construct
  source 1..25: mol_type = other DNA
cgcatatgcatcaaaaccacacaca

SEQ ID NO: 43054 - DNA, 24 bp, synthetic construct
  misc_feature 1..24: note = Synthetic Construct
  source 1..24: mol_type = other DNA
gtctgacagttgccaaagaccaaa

SEQ ID NO: 43055 - DNA, 24 bp, synthetic construct
  misc_feature 1..24: note = Synthetic Construct
  source 1..24: mol_type = other DNA
ccgaccagctaagctcatctcaag

SEQ ID NO: 43056 - DNA, 22 bp, synthetic construct
  misc_feature 1..22: note = Synthetic Construct
  source 1..22: mol_type = other DNA
ttggaaccactcctttcacaca

SEQ ID NO: 43057 - DNA, 25 bp, synthetic construct
  misc_feature 1..25: note = Synthetic Construct
  source 1..25: mol_type = other DNA
acctattgcttcattccacgttaga

SEQ ID NO: 43058 - DNA, 24 bp, synthetic construct
  misc_feature 1..24: note = Synthetic Construct
  source 1..24: mol_type = other DNA
atcagtatgacatccctgccaaat

SEQ ID NO: 43059 - DNA, 26 bp, synthetic construct
  misc_feature 1..26: note = Synthetic Construct
  source 1..26: mol_type = other DNA
gacctaacatgcagtttggagtcaag

SEQ ID NO: 43060 - DNA, 24 bp, synthetic construct
  misc_feature 1..24: note = Synthetic Construct
  source 1..24: mol_type = other DNA
cagcagtgtttttgagaggcattg

SEQ ID NO: 43061 - DNA, 24 bp, synthetic construct
  misc_feature 1..24: note = Synthetic Construct
  source 1..24: mol_type = other DNA
gccagaaaaggaagatcctagcaa

SEQ ID NO: 43062 - DNA, 25 bp, synthetic construct
  misc_feature 1..25: note = Synthetic Construct
  source 1..25: mol_type = other DNA
gatcacagtttgttccttgccatag

SEQ ID NO: 43063 - DNA, 23 bp, synthetic construct
  misc_feature 1..23: note = Synthetic Construct
  source 1..23: mol_type = other DNA
tgtctatccaccacaacctgagt

SEQ ID NO: 43064 - DNA, 20 bp, synthetic construct
  misc_feature 1..20: note = Synthetic Construct
  source 1..20: mol_type = other DNA
gcctctgtcccatgctcatc

SEQ ID NO: 43065 - DNA, 25 bp, synthetic construct
  misc_feature 1..25: note = Synthetic Construct
  source 1..25: mol_type = other DNA
accctcctcaacagaagtaactgaa

SEQ ID NO: 43066 - DNA, 20 bp, synthetic construct
  misc_feature 1..20: note = Synthetic Construct
  source 1..20: mol_type = other DNA
ccacacaggcatgtcccaaa

SEQ ID NO: 43067 - DNA, 21 bp, synthetic construct
  misc_feature 1..21: note = Synthetic Construct
  source 1..21: mol_type = other DNA
aggaactgtgctgcattccat

SEQ ID NO: 43068 - DNA, 22 bp, synthetic construct
  misc_feature 1..22: note = Synthetic Construct
  source 1..22: mol_type = other DNA
agcctacaaggggagcagagat

SEQ ID NO: 43069 - DNA, 19 bp, synthetic construct
  misc_feature 1..19: note = Synthetic Construct
  source 1..19: mol_type = other DNA
agacagtgggctgccgtta

SEQ ID NO: 43070 - DNA, 22 bp, synthetic construct
  misc_feature 1..22: note = Synthetic Construct
  source 1..22: mol_type = other DNA
gcctgaacccagacagatcaca

SEQ ID NO: 43071 - DNA, 27 bp, synthetic construct
  misc_feature 1..27: note = Synthetic Construct
  source 1..27: mol_type = other DNA
ctcttttcttgacacttgccttacaac

SEQ ID NO: 43072 - DNA, 22 bp, synthetic construct
  misc_feature 1..22: note = Synthetic Construct
  source 1..22: mol_type = other DNA
tgagtggtgccacttccacttc

SEQ ID NO: 43073 - DNA, 23 bp, synthetic construct
  misc_feature 1..23: note = Synthetic Construct
  source 1..23: mol_type = other DNA
ccatctgagacatgttgccagta

SEQ ID NO: 43074 - DNA, 28 bp, synthetic construct
  misc_feature 1..28: note = Synthetic Construct
  source 1..28: mol_type = other DNA
gactgtttaattggcccatagcttccta

SEQ ID NO: 43075 - DNA, 25 bp, synthetic construct
  misc_feature 1..25: note = Synthetic Construct
  source 1..25: mol_type = other DNA
cccaataggactttccaaacctgta

SEQ ID NO: 43076 - DNA, 23 bp, synthetic construct
  misc_feature 1..23: note = Synthetic Construct
  source 1..23: mol_type = other DNA
actttgagccattgtgtggaaga

SEQ ID NO: 43077 - DNA, 20 bp, synthetic construct
  misc_feature 1..20: note = Synthetic Construct
  source 1..20: mol_type = other DNA
ggaggcaaagccaggattca

SEQ ID NO: 43078 - DNA, 18 bp, synthetic construct
  misc_feature 1..18: note = Synthetic Construct
  source 1..18: mol_type = other DNA
tgggactcctgcggtgtt

SEQ ID NO: 43079 - DNA, 22 bp, synthetic construct
  misc_feature 1..22: note = Synthetic Construct
  source 1..22: mol_type = other DNA
ctcacactgtaccctcctggtt

SEQ ID NO: 43080 - DNA, 29 bp, synthetic construct
  misc_feature 1..29: note = Synthetic Construct
  source 1..29: mol_type = other DNA
cctggactcaaaagctaaggaggattcta

SEQ ID NO: 43081 - DNA, 24 bp, synthetic construct
  misc_feature 1..24: note = Synthetic Construct
  source 1..24: mol_type = other DNA
atgatggcctcggtattaaacagt

SEQ ID NO: 43082 - DNA, 20 bp, synthetic construct
  misc_feature 1..20: note = Synthetic Construct
  source 1..20: mol_type = other DNA
ggccaaattgccaggagctt

SEQ ID NO: 43083 - DNA, 26 bp, synthetic construct
  misc_feature 1..26: note = Synthetic Construct
  source 1..26: mol_type = other DNA
ggagaatttatgacttgggagaccat

SEQ ID NO: 43084 - DNA, 25 bp, synthetic construct
  misc_feature 1..25: note = Synthetic Construct
  source 1..25: mol_type = other DNA
tctgttgcaagcatttaaggggtat

SEQ ID NO: 43085 - DNA, 22 bp, synthetic construct
  misc_feature 1..22: note = Synthetic Construct
  source 1..22: mol_type = other DNA
ccgtccaaagggcagtttgtgt

SEQ ID NO: 43086 - DNA, 20 bp, synthetic construct
  misc_feature 1..20: note = Synthetic Construct
  source 1..20: mol_type = other DNA
gccttctgcaagctgtggtt

SEQ ID NO: 43087 - DNA, 24 bp, synthetic construct
  misc_feature 1..24: note = Synthetic Construct
  source 1..24: mol_type = other DNA
gggaagttcagattccagccacaa

SEQ ID NO: 43088 - DNA, 24 bp, synthetic construct
  misc_feature 1..24: note = Synthetic Construct
  source 1..24: mol_type = other DNA
ggcctccatgcagatattgggaaa

SEQ ID NO: 43089 - DNA, 22 bp, synthetic construct
  misc_feature 1..22: note = Synthetic Construct
  source 1..22: mol_type = other DNA
tgctccattggcaggaggtaac

SEQ ID NO: 43090 - DNA, 25 bp, synthetic construct
  misc_feature 1..25: note = Synthetic Construct
  source 1..25: mol_type = other DNA
gctgttaagtggtagggctgagcat

SEQ ID NO: 43091 - DNA, 28 bp, synthetic construct
  misc_feature 1..28: note = Synthetic Construct
  source 1..28: mol_type = other DNA
ggatagagtatgggaatgaaagggtaag

SEQ ID NO: 43092 - DNA, 22 bp, synthetic construct
  misc_feature 1..22: note = Synthetic Construct
  source 1..22: mol_type = other DNA
ggctagcccaggcttgttctta

SEQ ID NO: 43093 - DNA, 25 bp, synthetic construct
  misc_feature 1..25: note = Synthetic Construct
  source 1..25: mol_type = other DNA
agagaaatcaaggtttggtggaaga

SEQ ID NO: 43094 - DNA, 25 bp, synthetic construct
  misc_feature 1..25: note = Synthetic Construct
  source 1..25: mol_type = other DNA
cagtggtgtttgtaaggtaggcaat

SEQ ID NO: 43095 - DNA, 25 bp, synthetic construct
  misc_feature 1..25: note = Synthetic Construct
  source 1..25: mol_type = other DNA
tgtttaagagctgtggactctttca

SEQ ID NO: 43096 - DNA, 26 bp, synthetic construct
  misc_feature 1..26: note = Synthetic Construct
  source 1..26: mol_type = other DNA
cagtaatcctgattcaagaggggaaa

SEQ ID NO: 43097 - DNA, 22 bp, synthetic construct
  misc_feature 1..22: note = Synthetic Construct
  source 1..22: mol_type = other DNA
ccaccttgaggctccaagtaac

SEQ ID NO: 43098 - DNA, 23 bp, synthetic construct
  misc_feature 1..23: note = Synthetic Construct
  source 1..23: mol_type = other DNA
aaaacaactgcagctctgtcatc

SEQ ID NO: 43099 - DNA, 21 bp, synthetic construct
  misc_feature 1..21: note = Synthetic Construct
  source 1..21: mol_type = other DNA
tccagggcttctctgccaaca

SEQ ID NO: 43100 - DNA, 24 bp, synthetic construct
  misc_feature 1..24: note = Synthetic Construct
  source 1..24: mol_type = other DNA
aggattctggggtaaaaggaggtt

SEQ ID NO: 43101 - DNA, 20 bp, synthetic construct
  misc_feature 1..20: note = Synthetic Construct
  source 1..20: mol_type = other DNA
ggatgcaggcccttctctct

SEQ ID NO: 43102 - DNA, 21 bp, synthetic construct
  misc_feature 1..21: note = Synthetic Construct
  source 1..21: mol_type = other DNA
gccaacggctaagctaacgat

SEQ ID NO: 43103 - DNA, 23 bp, synthetic construct
  misc_feature 1..23: note = Synthetic Construct
  source 1..23: mol_type = other DNA
acagtaaacggctcccatttgtt

SEQ ID NO: 43104 - DNA, 20 bp, synthetic construct
  misc_feature 1..20: note = Synthetic Construct
  source 1..20: mol_type = other DNA
tgcctctccgcttagccaat

SEQ ID NO: 43105 - DNA, 23 bp, synthetic construct
  misc_feature 1..23: note = Synthetic Construct
  source 1..23: mol_type = other DNA
ggtaggatgaacacaggtcagtt

SEQ ID NO: 43106 - DNA, 25 bp, synthetic construct
  misc_feature 1..25: note = Synthetic Construct
  source 1..25: mol_type = other DNA
gatcttacatgtcccagtgttctgt

SEQ ID NO: 43107 - DNA, 22 bp, synthetic construct
  misc_feature 1..22: note = Synthetic Construct
  source 1..22: mol_type = other DNA
gatccatcccaacaagctcaga

SEQ ID NO: 43108 - DNA, 20 bp, synthetic construct
  misc_feature 1..20: note = Synthetic Construct
  source 1..20: mol_type = other DNA
tgtccacccacagctcagat

SEQ ID NO: 43109 - DNA, 21 bp, synthetic construct
  misc_feature 1..21: note = Synthetic Construct
  source 1..21: mol_type = other DNA
agccagaggtccctcagcaat

SEQ ID NO: 43110 - DNA, 20 bp, synthetic construct
  misc_feature 1..20: note = Synthetic Construct
  source 1..20: mol_type = other DNA
agttggcctctggagcacat

SEQ ID NO: 43111 - DNA, 23 bp, synthetic construct
  misc_feature 1..23: note = Synthetic Construct
  source 1..23: mol_type = other DNA
gcttaatgacggtgggtcctaca

SEQ ID NO: 43112 - DNA, 21 bp, synthetic construct
  misc_feature 1..21: note = Synthetic Construct
  source 1..21: mol_type = other DNA
ggatgtgttgccccaatctgt

SEQ ID NO: 43113 - DNA, 25 bp, synthetic construct
  misc_feature 1..25: note = Synthetic Construct
  source 1..25: mol_type = other DNA
gggcagaaaatgtcctcaggcataa

SEQ ID NO: 43114 - DNA, 25 bp, synthetic construct
  misc_feature 1..25: note = Synthetic Construct
  source 1..25: mol_type = other DNA
gccctcaccttttcatccaagagtt

SEQ ID NO: 43115 - DNA, 24 bp, synthetic construct
  misc_feature 1..24: note = Synthetic Construct
  source 1..24: mol_type = other DNA
cctgctccttttccacctttctac

SEQ ID NO: 43116 - DNA, 20 bp, synthetic construct
  misc_feature 1..20: note = Synthetic Construct
  source 1..20: mol_type = other DNA
aaggctgacagtccctcact

SEQ ID NO: 43117 - DNA, 23 bp, synthetic construct
  misc_feature 1..23: note = Synthetic Construct
  source 1..23: mol_type = other DNA
tgattgctgcctcaggatacttt

SEQ ID NO: 43118 - DNA, 22 bp, synthetic construct
  misc_feature 1..22: note = Synthetic Construct
  source 1..22: mol_type = other DNA
agagtgacgaacccaggcatag

SEQ ID NO: 43119 - DNA, 24 bp, synthetic construct
  misc_feature 1..24: note = Synthetic Construct
  source 1..24: mol_type = other DNA
cccatcctgtttgtagctggaatg

SEQ ID NO: 43120 - DNA, 19 bp, synthetic construct
  misc_feature 1..19: note = Synthetic Construct
  source 1..19: mol_type = other DNA
tgcactggcccgtgacgaa

SEQ ID NO: 43121 - DNA, 21 bp, synthetic construct
  misc_feature 1..21: note = Synthetic Construct
  source 1..21: mol_type = other DNA
agtctgggcagcagacagtga

SEQ ID NO: 43122 - DNA, 22 bp, synthetic construct
  misc_feature 1..22: note = Synthetic Construct
  source 1..22: mol_type = other DNA
tgctcaacttccctccctgact

SEQ ID NO: 43123 - DNA, 24 bp, synthetic construct
  misc_feature 1..24: note = Synthetic Construct
  source 1..24: mol_type = other DNA
gctgcattttggggtcctcctatt

SEQ ID NO: 43124 - DNA, 20 bp, synthetic construct
  misc_feature 1..20: note = Synthetic Construct
  source 1..20: mol_type = other DNA
ttcccctacagcagctccaa

SEQ ID NO: 43125 - DNA, 26 bp, synthetic construct
  misc_feature 1..26: note = Synthetic Construct
  source 1..26: mol_type = other DNA
gccttcatgcctgaacctatcctact

SEQ ID NO: 43126 - DNA, 26 bp, synthetic construct
  misc_feature 1..26: note = Synthetic Construct
  source 1..26: mol_type = other DNA
gggtttccacatagaaacaaggagaa

SEQ ID NO: 43127 - DNA, 20 bp, synthetic construct
  misc_feature 1..20: note = Synthetic Construct
  source 1..20: mol_type = other DNA
cctgctgttgttcccaggtt

SEQ ID NO: 43128 - DNA, 23 bp, synthetic construct
  misc_feature 1..23: note = Synthetic Construct
  source 1..23: mol_type = other DNA
aggtccctggagttccctctttc

SEQ ID NO: 43129 - DNA, 27 bp, synthetic construct
  misc_feature 1..27: note = Synthetic Construct
  source 1..27: mol_type = other DNA
gtgtgatacttccaggtaatgtgtgaa

SEQ ID NO: 43130 - DNA, 25 bp, synthetic construct
  misc_feature 1..25: note = Synthetic Construct
  source 1..25: mol_type = other DNA
ccttcctcaattggctgatggctaa

SEQ ID NO: 43131 - DNA, 23 bp, synthetic construct
  misc_feature 1..23: note = Synthetic Construct
  source 1..23: mol_type = other DNA
gccccaatttctcctccttccat

SEQ ID NO: 43132 - DNA, 23 bp, synthetic construct
  misc_feature 1..23: note = Synthetic Construct
  source 1..23: mol_type = other DNA
ggctaacatctgacactggcttt

SEQ ID NO: 43133 - DNA, 20 bp, synthetic construct
  misc_feature 1..20: note = Synthetic Construct
  source 1..20: mol_type = other DNA
tggctgcatgattcccagtt

SEQ ID NO: 43134 - DNA, 25 bp, synthetic construct
  misc_feature 1..25: note = Synthetic Construct
  source 1..25: mol_type = other DNA
atatctactgtgtgctgtgaactgt

SEQ ID NO: 43135 - DNA, 23 bp, synthetic construct
  misc_feature 1..23: note = Synthetic Construct
  source 1..23: mol_type = other DNA
acagtaggcattgggaaacttga

SEQ ID NO: 43136 - DNA, 20 bp, synthetic construct
  misc_feature 1..20: note = Synthetic Construct
  source 1..20: mol_type = other DNA
accgaaaaggctgtgtgtgt

SEQ ID NO: 43137 - DNA, 23 bp, synthetic construct
  misc_feature 1..23: note = Synthetic Construct
  source 1..23: mol_type = other DNA
acaaaggtaaaaggtggcagaga

SEQ ID NO: 43138 - DNA, 22 bp, synthetic construct
  misc_feature 1..22: note = Synthetic Construct
  source 1..22: mol_type = other DNA
agttgtttacccagcacacact

SEQ ID NO: 43139 - DNA, 24 bp, synthetic construct
  misc_feature 1..24: note = Synthetic Construct
  source 1..24: mol_type = other DNA
gtgggaatggagctcctgtacttg

SEQ ID NO: 43140 - DNA, 23 bp, synthetic construct
  misc_feature 1..23: note = Synthetic Construct
  source 1..23: mol_type = other DNA
gctggaacctgtttccccttatg

SEQ ID NO: 43141 - DNA, 23 bp, synthetic construct
  misc_feature 1..23: note = Synthetic Construct
  source 1..23: mol_type = other DNA
ctttctactgctgccttgctttc

SEQ ID NO: 43142 - DNA, 24 bp, synthetic construct
  misc_feature 1..24: note = Synthetic Construct
  source 1..24: mol_type = other DNA
gggtgagggtacactccagtaaaa

SEQ ID NO: 43143 - DNA, 20 bp, synthetic construct
  misc_feature 1..20: note = Synthetic Construct
  source 1..20: mol_type = other DNA
ggcatggcccttttccttgt

SEQ ID NO: 43144 - DNA, 22 bp, synthetic construct
  misc_feature 1..22: note = Synthetic Construct
  source 1..22: mol_type = other DNA
accaggacgtcaccacagaaac

SEQ ID NO: 43145 - DNA, 25 bp, synthetic construct
  misc_feature 1..25: note = Synthetic Construct
  source 1..25: mol_type = other DNA
ggctagtaactaactgccctgaatc

SEQ ID NO: 43146 - DNA, 24 bp, synthetic construct
  misc_feature 1..24: note = Synthetic Construct
  source 1..24: mol_type = other DNA
gcctcactctgccttatggtgcat

SEQ ID NO: 43147 - DNA, 25 bp, synthetic construct
  misc_feature 1..25: note = Synthetic Construct
  source 1..25: mol_type = other DNA
acagctgttttatcctgaggctatt

SEQ ID NO: 43148 - DNA, 25 bp, synthetic construct
  misc_feature 1..25: note = Synthetic Construct
  source 1..25: mol_type = other DNA
ctctctggtagttgctgttggtttc

SEQ ID NO: 43149 - DNA, 28 bp, synthetic construct
  misc_feature 1..28: note = Synthetic Construct
  source 1..28: mol_type = other DNA
ggtggggagagaagagatgctatttttg

SEQ ID NO: 43150 - DNA, 29 bp, synthetic construct
  misc_feature 1..29: note = Synthetic Construct
  source 1..29: mol_type = other DNA
ggtctataacctctgtgaaagccatcctt

SEQ ID NO: 43151 - DNA, 24 bp, synthetic construct
  misc_feature 1..24: note = Synthetic Construct
  source 1..24: mol_type = other DNA
tttactctgaggaacagcaaggtt

SEQ ID NO: 43152 - DNA, 21 bp, synthetic construct
  misc_feature 1..21: note = Synthetic Construct
  source 1..21: mol_type = other DNA
gtgcagccagaagtgacaaac

SEQ ID NO: 43153 - DNA, 22 bp, synthetic construct
  misc_feature 1..22: note = Synthetic Construct
  source 1..22: mol_type = other DNA
ccgagtgtgctgttctcacaga

SEQ ID NO: 43154 - DNA, 20 bp, synthetic construct
  misc_feature 1..20: note = Synthetic Construct
  source 1..20: mol_type = other DNA
ttctccctgcccttcctgtt

SEQ ID NO: 43155 - DNA, 22 bp, synthetic construct
  misc_feature 1..22: note = Synthetic Construct
  source 1..22: mol_type = other DNA
agagacctttgcagcccaatag

SEQ ID NO: 43156 - DNA, 24 bp, synthetic construct
  misc_feature 1..24: note = Synthetic Construct
  source 1..24: mol_type = other DNA
gcagctgtcattttgctggagtag

SEQ ID NO: 43157 - DNA, 20 bp, synthetic construct
  misc_feature 1..20: note = Synthetic Construct
  source 1..20: mol_type = other DNA
tgcctagagccgcctttaac

SEQ ID NO: 43158 - DNA, 19 bp, synthetic construct
  misc_feature 1..19: note = Synthetic Construct
  source 1..19: mol_type = other DNA
tggtgggtgcccactttct

SEQ ID NO: 43159 - DNA, 25 bp, synthetic construct
  misc_feature 1..25: note = Synthetic Construct
  source 1..25: mol_type = other DNA
agtgagaatgtgttttggctgtact

SEQ ID NO: 43160 - DNA, 23 bp, synthetic construct
  misc_feature 1..23: note = Synthetic Construct
  source 1..23: mol_type = other DNA
ctctgtcctcacaaaaccagtgt

SEQ ID NO: 43161 - DNA, 25 bp, synthetic construct
  misc_feature 1..25: note = Synthetic Construct
  source 1..25: mol_type = other DNA
gtgtctttccttgttgctcttccaa

SEQ ID NO: 43162 - DNA, 26 bp, synthetic construct
  misc_feature 1..26: note = Synthetic Construct
  source 1..26: mol_type = other DNA
cacagtcacagtttgtagggactatc

SEQ ID NO: 43163 - DNA, 27 bp, synthetic construct
  misc_feature 1..27: note = Synthetic Construct
  source 1..27: mol_type = other DNA
gcaaaatcgatgtgaattctggacttg

SEQ ID NO: 43164 - DNA, 29 bp, synthetic construct
  misc_feature 1..29: note = Synthetic Construct
  source 1..29: mol_type = other DNA
ccaccacctgttttgtaagaaaagcttca

SEQ ID NO: 43165 - DNA, 20 bp, synthetic construct
  misc_feature 1..20: note = Synthetic Construct
  source 1..20: mol_type = other DNA
actgcagcactcggctcatt

SEQ ID NO: 43166 - DNA, 25 bp, synthetic construct
  misc_feature 1..25: note = Synthetic Construct
  source 1..25: mol_type = other DNA
gaggaatgaacagtttaggggaact

SEQ ID NO: 43167 - DNA, 24 bp, synthetic construct
  misc_feature 1..24: note = Synthetic Construct
  source 1..24: mol_type = other DNA
acaggtctctccctgcctctaatc

SEQ ID NO: 43168 - DNA, 23 bp, synthetic construct
  misc_feature 1..23: note = Synthetic Construct
  source 1..23: mol_type = other DNA
caagctctttgtccacctgtttc

SEQ ID NO: 43169 - DNA, 21 bp, synthetic construct
  misc_feature 1..21: note = Synthetic Construct
  source 1..21: mol_type = other DNA
tgtgctcctctggaggcaatc

SEQ ID NO: 43170 - DNA, 25 bp, synthetic construct
  misc_feature 1..25: note = Synthetic Construct
  source 1..25: mol_type = other DNA
gcctgcctctaacatcaccctctta

SEQ ID NO: 43171 - DNA, 22 bp, synthetic construct
  misc_feature 1..22: note = Synthetic Construct
  source 1..22: mol_type = other DNA
gacgcagagccagagtgtaaag

SEQ ID NO: 43172 - DNA, 26 bp, synthetic construct
  misc_feature 1..26: note = Synthetic Construct
  source 1..26: mol_type = other DNA
cccatgtttttgagcaggagggattg

SEQ ID NO: 43173 - DNA, 21 bp, synthetic construct
  misc_feature 1..21: note = Synthetic Construct
  source 1..21: mol_type = other DNA
tccggactcctctgctccaat

SEQ ID NO: 43174 - DNA, 23 bp, synthetic construct
  misc_feature 1..23: note = Synthetic Construct
  source 1..23: mol_type = other DNA
gagttatgattgcaggccacgtt

SEQ ID NO: 43175 - DNA, 24 bp, synthetic construct
  misc_feature 1..24: note = Synthetic Construct
  source 1..24: mol_type = other DNA
aactgtcacaggaaggaacagaaa

SEQ ID NO: 43176 - DNA, 24 bp, synthetic construct
  misc_feature 1..24: note = Synthetic Construct
  source 1..24: mol_type = other DNA
gtcagagcctaacagcctttgata

SEQ ID NO: 43177 - DNA, 22 bp, synthetic construct
  misc_feature 1..22: note = Synthetic Construct
  source 1..22: mol_type = other DNA
acaatgtggtgaggtgtgttga

SEQ ID NO: 43178 - DNA, 22 bp, synthetic construct
  misc_feature 1..22: note = Synthetic Construct
  source 1..22: mol_type = other DNA
cggacatagctgtggtgcagat

SEQ ID NO: 43179 - DNA, 22 bp, synthetic construct
  misc_feature 1..22: note = Synthetic Construct
  source 1..22: mol_type = other DNA
tcacaagcaggtgtccaaggaa

SEQ ID NO: 43180 - DNA, 22 bp, synthetic construct
  misc_feature 1..22: note = Synthetic Construct
  source 1..22: mol_type = other DNA
gcagggacatatgttgcaggta

SEQ ID NO: 43181 - DNA, 21 bp, synthetic construct
  misc_feature 1..21: note = Synthetic Construct
  source 1..21: mol_type = other DNA
gacgctgacgttactgctaga

SEQ ID NO: 43182 - DNA, 27 bp, synthetic construct
  misc_feature 1..27: note = Synthetic Construct
  source 1..27: mol_type = other DNA
cccaacgacatatgttggagtggattc

SEQ ID NO: 43183 - DNA, 27 bp, synthetic construct
  misc_feature 1..27: note = Synthetic Construct
  source 1..27: mol_type = other DNA
gtctggtaggacaaaagatccttcaac

SEQ ID NO: 43184 - DNA, 23 bp, synthetic construct
  misc_feature 1..23: note = Synthetic Construct
  source 1..23: mol_type = other DNA
gagacctggcttctagccaaaga

SEQ ID NO: 43185 - DNA, 25 bp, synthetic construct
  misc_feature 1..25: note = Synthetic Construct
  source 1..25: mol_type = other DNA
gggcctttttaaggtcctgggcata

SEQ ID NO: 43186 - DNA, 23 bp, synthetic construct
  misc_feature 1..23: note = Synthetic Construct
  source 1..23: mol_type = other DNA
gtggcttcctgaacacgtacact

SEQ ID NO: 43187 - DNA, 25 bp, synthetic construct
  misc_feature 1..25: note = Synthetic Construct
  source 1..25: mol_type = other DNA
gtcagtaaatgaagtgcctgctgat

SEQ ID NO: 43188 - DNA, 20 bp, synthetic construct
  misc_feature 1..20: note = Synthetic Construct
  source 1..20: mol_type = other DNA
acagagcaggcagtgcatca

SEQ ID NO: 43189 - DNA, 21 bp, synthetic construct
  misc_feature 1..21: note = Synthetic Construct
  source 1..21: mol_type = other DNA
cagagaaggaccagggagcat

SEQ ID NO: 43190 - DNA, 21 bp, synthetic construct
  misc_feature 1..21: note = Synthetic Construct
  source 1..21: mol_type = other DNA
agccagtgctagctgggaaca

SEQ ID NO: 43191 - DNA, 21 bp, synthetic construct
  misc_feature 1..21: note = Synthetic Construct
  source 1..21: mol_type = other DNA
tgagcctggacagctgtggta

SEQ ID NO: 43192 - DNA, 22 bp, synthetic construct
  misc_feature 1..22: note = Synthetic Construct
  source 1..22: mol_type = other DNA
aacaaggaagccagttggagtt

SEQ ID NO: 43193 - DNA, 27 bp, synthetic construct
  misc_feature 1..27: note = Synthetic Construct
  source 1..27: mol_type = other DNA
agcgggataataaactaagctcagaag

SEQ ID NO: 43194 - DNA, 26 bp, synthetic construct
  misc_feature 1..26: note = Synthetic Construct
  source 1..26: mol_type = other DNA
cctggaagcttctgaaacagtaggaa

SEQ ID NO: 43195 - DNA, 26 bp, synthetic construct
  misc_feature 1..26: note = Synthetic Construct
  source 1..26: mol_type = other DNA
agctttaaggactcaagaaggacaag

SEQ ID NO: 43196 - DNA, 24 bp, synthetic construct
  misc_feature 1..24: note = Synthetic Construct
  source 1..24: mol_type = other DNA
ggaaaacatgacggggaaggatag

SEQ ID NO: 43197 - DNA, 20 bp, synthetic construct
  misc_feature 1..20: note = Synthetic Construct
  source 1..20: mol_type = other DNA
tgctgggagctgtgtgtgta

SEQ ID NO: 43198 - DNA, 25 bp, synthetic construct
  misc_feature 1..25: note = Synthetic Construct
  source 1..25: mol_type = other DNA
gttgtcagtgagaaatggctaccaa

SEQ ID NO: 43199 - DNA, 24 bp, synthetic construct
  misc_feature 1..24: note = Synthetic Construct
  source 1..24: mol_type = other DNA
tgttttacatcagggcagaacgat

SEQ ID NO: 43200 - DNA, 26 bp, synthetic construct
  misc_feature 1..26: note = Synthetic Construct
  source 1..26: mol_type = other DNA
gcccagcaagaaactattcctaccta

SEQ ID NO: 43201 - DNA, 19 bp, synthetic construct
  misc_feature 1..19: note = Synthetic Construct
  source 1..19: mol_type = other DNA
agccgtccagccgtgaaca

SEQ ID NO: 43202 - DNA, 26 bp, synthetic construct
  misc_feature 1..26: note = Synthetic Construct
  source 1..26: mol_type = other DNA
gccgatgacaaacagacctctaggaa

SEQ ID NO: 43203 - DNA, 21 bp, synthetic construct
  misc_feature 1..21: note = Synthetic Construct
  source 1..21: mol_type = other DNA
cccactgcagaaacggtccta

SEQ ID NO: 43204 - DNA, 22 bp, synthetic construct
  misc_feature 1..22: note = Synthetic Construct
  source 1..22: mol_type = other DNA
cagagttgggaggtggaagaca

SEQ ID NO: 43205 - DNA, 25 bp, synthetic construct
  misc_feature 1..25: note = Synthetic Construct
  source 1..25: mol_type = other DNA
ggcagaaatctttgctgttgagtga

SEQ ID NO: 43206 - DNA, 21 bp, synthetic construct
  misc_feature 1..21: note = Synthetic Construct
  source 1..21: mol_type = other DNA
ttgggcttcccagtccccttt

SEQ ID NO: 43207 - DNA, 23 bp, synthetic construct
  misc_feature 1..23: note = Synthetic Construct
  source 1..23: mol_type = other DNA
ccagtaaagcctgtttgctctct

SEQ ID NO: 43208 - DNA, 20 bp, synthetic construct
  misc_feature 1..20: note = Synthetic Construct
  source 1..20: mol_type = other DNA
ctgctggctttgccacttgt

SEQ ID NO: 43209 - DNA, 21 bp, synthetic construct
  misc_feature 1..21: note = Synthetic Construct
  source 1..21: mol_type = other DNA
tggcatggacgctgtggatag

SEQ ID NO: 43210 - DNA, 21 bp, synthetic construct
  misc_feature 1..21: note = Synthetic Construct
  source 1..21: mol_type = other DNA
aaagcctctgggagcctctct

SEQ ID NO: 43211 - DNA, 20 bp, synthetic construct
  misc_feature 1..20: note = Synthetic Construct
  source 1..20: mol_type = other DNA
gcatccagcccaacccctaa

SEQ ID NO: 43212 - DNA, 23 bp, synthetic construct
  misc_feature 1..23: note = Synthetic Construct
  source 1..23: mol_type = other DNA
cctgcaaatgtggctgctgttag

SEQ ID NO: 43213 - DNA, 25 bp, synthetic construct
  misc_feature 1..25: note = Synthetic Construct
  source 1..25: mol_type = other DNA
ccagctgaattctaagcctcacaca

SEQ ID NO: 43214 - DNA, 22 bp, synthetic construct
  misc_feature 1..22: note = Synthetic Construct
  source 1..22: mol_type = other DNA
ggaccctctgggttcaaagcta

SEQ ID NO: 43215 - DNA, 23 bp, synthetic construct
  misc_feature 1..23: note = Synthetic Construct
  source 1..23: mol_type = other DNA
ggtggcaactttagcctctgaac

SEQ ID NO: 43216 - DNA, 23 bp, synthetic construct
  misc_feature 1..23: note = Synthetic Construct
  source 1..23: mol_type = other DNA
gaggccatgtctcaaaacacaca

SEQ ID NO: 43217 - DNA, 20 bp, synthetic construct
  misc_feature 1..20: note = Synthetic Construct
  source 1..20: mol_type = other DNA
cacgtttcccggatcctcaa

SEQ ID NO: 43218 - DNA, 26 bp, synthetic construct
  misc_feature 1..26: note = Synthetic Construct
  source 1..26: mol_type = other DNA
ctgggtaccagaaaagtggaatgtct

SEQ ID NO: 43219 - DNA, 22 bp, synthetic construct
  misc_feature 1..22: note = Synthetic Construct
  source 1..22: mol_type = other DNA
aggtcggagggagaatgagtga

SEQ ID NO: 43220 - DNA, 21 bp, synthetic construct
  misc_feature 1..21: note = Synthetic Construct
  source 1..21: mol_type = other DNA
gtgaggcaacgcctaagttct

SEQ ID NO: 43221 - DNA, 30 bp, synthetic construct
  misc_feature 1..30: note = Synthetic Construct
  source 1..30: mol_type = other DNA
gcctcattctctttctttcaaaccgagttc

SEQ ID NO: 43222 - DNA, 21 bp, synthetic construct
  misc_feature 1..21: note = Synthetic Construct
  source 1..21: mol_type = other DNA
accccgaccagtggagacttt

SEQ ID NO: 43223 - DNA, 24 bp, synthetic construct
  misc_feature 1..24: note = Synthetic Construct
  source 1..24: mol_type = other DNA
cagtcaccacaacctcaatgtaga

SEQ ID NO: 43224 - DNA, 25 bp, synthetic construct
  misc_feature 1..25: note = Synthetic Construct
  source 1..25: mol_type = other DNA
gcttatggcacagggttttgtgaag

SEQ ID NO: 43225 - DNA, 22 bp, synthetic construct
  misc_feature 1..22: note = Synthetic Construct
  source 1..22: mol_type = other DNA
agcgtccctccaaccttagtgt

SEQ ID NO: 43226 - DNA, 24 bp, synthetic construct
  misc_feature 1..24: note = Synthetic Construct
  source 1..24: mol_type = other DNA
gacagcagctgacggtttaagttc

SEQ ID NO: 43227 - DNA, 22 bp, synthetic construct
  misc_feature 1..22: note = Synthetic Construct
  source 1..22: mol_type = other DNA
gagagtgcttttggctcagaga

SEQ ID NO: 43228 - DNA, 24 bp, synthetic construct
  misc_feature 1..24: note = Synthetic Construct
  source 1..24: mol_type = other DNA
cccagggaaactggttcaaagaca

SEQ ID NO: 43229 - DNA, 22 bp, synthetic construct
  misc_feature 1..22: note = Synthetic Construct
  source 1..22: mol_type = other DNA
tggggagacctatgggctttac

SEQ ID NO: 43230 - DNA, 23 bp, synthetic construct
  misc_feature 1..23: note = Synthetic Construct
  source 1..23: mol_type = other DNA
ggagtgaacccagaaggctttga

SEQ ID NO: 43231 - DNA, 20 bp, synthetic construct
  misc_feature 1..20: note = Synthetic Construct
  source 1..20: mol_type = other DNA
atgcccactgcactctctct

SEQ ID NO: 43232 - DNA, 24 bp, synthetic construct
  misc_feature 1..24: note = Synthetic Construct
  source 1..24: mol_type = other DNA
attttcttcctaaccaccggcata

SEQ ID NO: 43233 - DNA, 20 bp, synthetic construct
  misc_feature 1..20: note = Synthetic Construct
  source 1..20: mol_type = other DNA
aaggggctgaggtgggagaa

SEQ ID NO: 43234 - DNA, 23 bp, synthetic construct
  misc_feature 1..23: note = Synthetic Construct
  source 1..23: mol_type = other DNA
gggatgtacttcgtggggtgtag

SEQ ID NO: 43235 - DNA, 24 bp, synthetic construct
  misc_feature 1..24: note = Synthetic Construct
  source 1..24: mol_type = other DNA
tgagcaaaccaaacggatgtatgt

SEQ ID NO: 43236 - DNA, 28 bp, synthetic construct
  misc_feature 1..28: note = Synthetic Construct
  source 1..28: mol_type = other DNA
gctgtgtgattgacagatcttcctgtga

SEQ ID NO: 43237 - DNA, 22 bp, synthetic construct
  misc_feature 1..22: note = Synthetic Construct
  source 1..22: mol_type = other DNA
gtgatgacagttggctgacgat

SEQ ID NO: 43238 - DNA, 24 bp, synthetic construct
  misc_feature 1..24: note = Synthetic Construct
  source 1..24: mol_type = other DNA
tgatcgtctctaccccttgaaact

SEQ ID NO: 43239 - DNA, 20 bp, synthetic construct
  misc_feature 1..20: note = Synthetic Construct
  source 1..20: mol_type = other DNA
cctctgccacaggtgaccaa

SEQ ID NO: 43240 - DNA, 27 bp, synthetic construct
  misc_feature 1..27: note = Synthetic Construct
  source 1..27: mol_type = other DNA
agatctgagtaatgtctctggaagtga

SEQ ID NO: 43241 - DNA, 20 bp, synthetic construct
  misc_feature 1..20: note = Synthetic Construct
  source 1..20: mol_type = other DNA
cctggccgtggagttggttt

SEQ ID NO: 43242 - DNA, 20 bp, synthetic construct
  misc_feature 1..20: note = Synthetic Construct
  source 1..20: mol_type = other DNA
tcccatcgcccaggtacaga

SEQ ID NO: 43243 - DNA, 22 bp, synthetic construct
  misc_feature 1..22: note = Synthetic Construct
  source 1..22: mol_type = other DNA
ccatctggaaccacctggtgaa

SEQ ID NO: 43244 - DNA, 23 bp, synthetic construct
  misc_feature 1..23: note = Synthetic Construct
  source 1..23: mol_type = other DNA
cccagttttcagatcccagttgt

SEQ ID NO: 43245 - DNA, 19 bp, synthetic construct
  misc_feature 1..19: note = Synthetic Construct
  source 1..19: mol_type = other DNA
gggtgggtggtgaggagat

SEQ ID NO: 43246 - DNA, 24 bp, synthetic construct
  misc_feature 1..24: note = Synthetic Construct
  source 1..24: mol_type = other DNA
ccagggctttacacacacagagaa

SEQ ID NO: 43247 - DNA, 24 bp, synthetic construct
  misc_feature 1..24: note = Synthetic Construct
  source 1..24: mol_type = other DNA
tcagtggtctatgcaagcctaatc

SEQ ID NO: 43248 - DNA, 25 bp, synthetic construct
  misc_feature 1..25: note = Synthetic Construct
  source 1..25: mol_type = other DNA
cgatgtaagggtgcaggagaacaga

SEQ ID NO: 43249 - DNA, 21 bp, synthetic construct
  misc_feature 1..21: note = Synthetic Construct
  source 1..21: mol_type = other DNA
tcctcatgctcctcgtggaat

SEQ ID NO: 43250 - DNA, 20 bp, synthetic construct
  misc_feature 1..20: note = Synthetic Construct
  source 1..20: mol_type = other DNA
ctgcaaatgacgccctctga

SEQ ID NO: 43251 - DNA, 24 bp, synthetic construct
  misc_feature 1..24: note = Synthetic Construct
  source 1..24: mol_type = other DNA
gctttgagctggtatggagaacaa

SEQ ID NO: 43252 - DNA, 24 bp, synthetic construct
  misc_feature 1..24: note = Synthetic Construct
  source 1..24: mol_type = other DNA
gaccttccagaagaccctctcttg

SEQ ID NO: 43253 - DNA, 21 bp, synthetic construct
  misc_feature 1..21: note = Synthetic Construct
  source 1..21: mol_type = other DNA
gccgatcaccctgcattcctt

SEQ ID NO: 43254 - DNA, 22 bp, synthetic construct
  misc_feature 1..22: note = Synthetic Construct
  source 1..22: mol_type = other DNA
gcctgaagaggacgaactgttg

SEQ ID NO: 43255 - DNA, 23 bp, synthetic construct
  misc_feature 1..23: note = Synthetic Construct
  source 1..23: mol_type = other DNA
gggtgcctggaggaataccaatc

SEQ ID NO: 43256 - DNA, 23 bp, synthetic construct
  misc_feature 1..23: note = Synthetic Construct
  source 1..23: mol_type = other DNA
gtgcaagctatgcaagggtgatg

SEQ ID NO: 43257 - DNA, 26 bp, synthetic construct
  misc_feature 1..26: note = Synthetic Construct
  source 1..26: mol_type = other DNA
acagaaaaggagttaagagggagttg

SEQ ID NO: 43258 - DNA, 24 bp, synthetic construct
  misc_feature 1..24: note = Synthetic Construct
  source 1..24: mol_type = other DNA
gagcttagaaaactctgcctctga

SEQ ID NO: 43259 - DNA, 23 bp, synthetic construct
  misc_feature 1..23: note = Synthetic Construct
  source 1..23: mol_type = other DNA
aacagactcctgcttcctcattc

SEQ ID NO: 43260 - DNA, 19 bp, synthetic construct
  misc_feature 1..19: note = Synthetic Construct
  source 1..19: mol_type = other DNA
aagccacggacgggtacta

SEQ ID NO: 43261 - DNA, 22 bp, synthetic construct
  misc_feature 1..22: note = Synthetic Construct
  source 1..22: mol_type = other DNA
tgtccactcttgactgcctcta

SEQ ID NO: 43262 - DNA, 20 bp, synthetic construct
  misc_feature 1..20: note = Synthetic Construct
  source 1..20: mol_type = other DNA
gcatgcagccacaaggaaca

SEQ ID NO: 43263 - DNA, 22 bp, synthetic construct
  misc_feature 1..22: note = Synthetic Construct
  source 1..22: mol_type = other DNA
tgatcctcctcagcttcgtttg

SEQ ID NO: 43264 - DNA, 24 bp, synthetic construct
  misc_feature 1..24: note = Synthetic Construct
  source 1..24: mol_type = other DNA
gctggttccagaggagtaggactt

SEQ ID NO: 43265 - DNA, 22 bp, synthetic construct
  misc_feature 1..22: note = Synthetic Construct
  source 1..22: mol_type = other DNA
gcaggctggctgatttccaaca

SEQ ID NO: 43266 - DNA, 27 bp, synthetic construct
  misc_feature 1..27: note = Synthetic Construct
  source 1..27: mol_type = other DNA
gcctgttaataaaggtgttgggtctga

SEQ ID NO: 43267 - DNA, 23 bp, synthetic construct
  misc_feature 1..23: note = Synthetic Construct
  source 1..23: mol_type = other DNA
ctccaaggctcttatcccaggaa

SEQ ID NO: 43268 - DNA, 21 bp, synthetic construct
  misc_feature 1..21: note = Synthetic Construct
  source 1..21: mol_type = other DNA
ccccgatctccgagtacagat

SEQ ID NO: 43269 - DNA, 21 bp, synthetic construct
  misc_feature 1..21: note = Synthetic Construct
  source 1..21: mol_type = other DNA
tccagttccacatgcctccta

SEQ ID NO: 43270 - DNA, 20 bp, synthetic construct
  misc_feature 1..20: note = Synthetic Construct
  source 1..20: mol_type = other DNA
gacagcacagcaccactttg

SEQ ID NO: 43271 - DNA, 26 bp, synthetic construct
  misc_feature 1..26: note = Synthetic Construct
  source 1..26: mol_type = other DNA
cagatcactgtagttctctccagtct

SEQ ID NO: 43272 - DNA, 21 bp, synthetic construct
  misc_feature 1..21: note = Synthetic Construct
  source 1..21: mol_type = other DNA
ccaaggaagccctgagtccat

SEQ ID NO: 43273 - DNA, 22 bp, synthetic construct
  misc_feature 1..22: note = Synthetic Construct
  source 1..22: mol_type = other DNA
gcacatccagcgcaaactggta

SEQ ID NO: 43274 - DNA, 24 bp, synthetic construct
  misc_feature 1..24: note = Synthetic Construct
  source 1..24: mol_type = other DNA
ggtgtgggcgtgaatatagaccaa

SEQ ID NO: 43275 - DNA, 22 bp, synthetic construct
  misc_feature 1..22: note = Synthetic Construct
  source 1..22: mol_type = other DNA
cctcaccgccgtgtcatttgaa

SEQ ID NO: 43276 - DNA, 23 bp, synthetic construct
  misc_feature 1..23: note = Synthetic Construct
  source 1..23: mol_type = other DNA
ggcagttacctcctccaacattc

SEQ ID NO: 43277 - DNA, 25 bp, synthetic construct
  misc_feature 1..25: note = Synthetic Construct
  source 1..25: mol_type = other DNA
ggaaccacaggtgaaatagggaagt

SEQ ID NO: 43278 - DNA, 22 bp, synthetic construct
  misc_feature 1..22: note = Synthetic Construct
  source 1..22: mol_type = other DNA
gctttgtcaaatggcccagcta

SEQ ID NO: 43279 - DNA, 21 bp, synthetic construct
  misc_feature 1..21: note = Synthetic Construct
  source 1..21: mol_type = other DNA
ggaacatccctcagccaaaca

SEQ ID NO: 43280 - DNA, 25 bp, synthetic construct
  misc_feature 1..25: note = Synthetic Construct
  source 1..25: mol_type = other DNA
gctttccaaagagatctaggacaca

SEQ ID NO: 43281 - DNA, 21 bp, synthetic construct
  misc_feature 1..21: note = Synthetic Construct
  source 1..21: mol_type = other DNA
ggttctccacgggaccctttc

SEQ ID NO: 43282 - DNA, 25 bp, synthetic construct
  misc_feature 1..25: note = Synthetic Construct
  source 1..25: mol_type = other DNA
ctccaaggaggaccaattctcttgt

SEQ ID NO: 43283 - DNA, 23 bp, synthetic construct
  misc_feature 1..23: note = Synthetic Construct
  source 1..23: mol_type = other DNA
caatgactggatgtgtggctctt

SEQ ID NO: 43284 - DNA, 23 bp, synthetic construct
  misc_feature 1..23: note = Synthetic Construct
  source 1..23: mol_type = other DNA
gagaagactgcacctgaccatac

SEQ ID NO: 43285 - DNA, 25 bp, synthetic construct
  misc_feature 1..25: note = Synthetic Construct
  source 1..25: mol_type = other DNA
gcagagccaacttttaaacccagat

SEQ ID NO: 43286 - DNA, 23 bp, synthetic construct
  misc_feature 1..23: note = Synthetic Construct
  source 1..23: mol_type = other DNA
tgcatgtcccagagctctatact

SEQ ID NO: 43287 - DNA, 21 bp, synthetic construct
  misc_feature 1..21: note = Synthetic Construct
  source 1..21: mol_type = other DNA
ccccacattccatgcctgcta

SEQ ID NO: 43288 - DNA, 25 bp, synthetic construct
  misc_feature 1..25: note = Synthetic Construct
  source 1..25: mol_type = other DNA
ccaggacatctacatgcaggagctt

SEQ ID NO: 43289 - DNA, 25 bp, synthetic construct
  misc_feature 1..25: note = Synthetic Construct
  source 1..25: mol_type = other DNA
aacaagagaactggacccttagttc

SEQ ID NO: 43290 - DNA, 25 bp, synthetic construct
  misc_feature 1..25: note = Synthetic Construct
  source 1..25: mol_type = other DNA
gttaacttcagcatggcagaaaaac

SEQ ID NO: 43291 - DNA, 22 bp, synthetic construct
  misc_feature 1..22: note = Synthetic Construct
  source 1..22: mol_type = other DNA
ttatggagcgcatgtacacagt

SEQ ID NO: 43292 - DNA, 21 bp, synthetic construct
  misc_feature 1..21: note = Synthetic Construct
  source 1..21: mol_type = other DNA
gccccagtgactcacaccaat

SEQ ID NO: 43293 - DNA, 21 bp, synthetic construct
  misc_feature 1..21: note = Synthetic Construct
  source 1..21: mol_type = other DNA
ccaggaccgacgttgtcatct

SEQ ID NO: 43294 - DNA, 21 bp, synthetic construct
  misc_feature 1..21: note = Synthetic Construct
  source 1..21: mol_type = other DNA
gccttggtttgctctctgcaa

SEQ ID NO: 43295 - DNA, 22 bp, synthetic construct
  misc_feature 1..22: note = Synthetic Construct
  source 1..22: mol_type = other DNA
cggtcaggccttctcttggttt

SEQ ID NO: 43296 - DNA, 22 bp, synthetic construct
  misc_feature 1..22: note = Synthetic Construct
  source 1..22: mol_type = other DNA
cactttcagtgcaggtggtttg

SEQ ID NO: 43297 - DNA, 22 bp, synthetic construct
  misc_feature 1..22: note = Synthetic Construct
  source 1..22: mol_type = other DNA
ggagcagccacagatcctttgt

SEQ ID NO: 43298 - DNA, 24 bp, synthetic construct
  misc_feature 1..24: note = Synthetic Construct
  source 1..24: mol_type = other DNA
gtctttcaaaggcaaactccactt

SEQ ID NO: 43299 - DNA, 24 bp, synthetic construct
  misc_feature 1..24: note = Synthetic Construct
  source 1..24: mol_type = other DNA
ggtcagcttatccactctggattc

SEQ ID NO: 43300 - DNA, 21 bp, synthetic construct
  misc_feature 1..21: note = Synthetic Construct
  source 1..21: mol_type = other DNA
tgcaaactagggaaccagcaa

SEQ ID NO: 43301 - DNA, 20 bp, synthetic construct
  misc_feature 1..20: note = Synthetic Construct
  source 1..20: mol_type = other DNA
ccctgagaagcggcagtgtt

SEQ ID NO: 43302 - DNA, 25 bp, synthetic construct
  misc_feature 1..25: note = Synthetic Construct
  source 1..25: mol_type = other DNA
ggagtcaggtctaaggaagtctgta

SEQ ID NO: 43303 - DNA, 24 bp, synthetic construct
  misc_feature 1..24: note = Synthetic Construct
  source 1..24: mol_type = other DNA
ggccagaagaagcacttccccttt

SEQ ID NO: 43304 - DNA, 20 bp, synthetic construct
  misc_feature 1..20: note = Synthetic Construct
  source 1..20: mol_type = other DNA
agggcagggtaggggacata

SEQ ID NO: 43305 - DNA, 21 bp, synthetic construct
  misc_feature 1..21: note = Synthetic Construct
  source 1..21: mol_type = other DNA
tccctttccctggttgagctt

SEQ ID NO: 43306 - DNA, 21 bp, synthetic construct
  misc_feature 1..21: note = Synthetic Construct
  source 1..21: mol_type = other DNA
tggcaagtgtgtccaaggaat

SEQ ID NO: 43307 - DNA, 20 bp, synthetic construct
  misc_feature 1..20: note = Synthetic Construct
  source 1..20: mol_type = other DNA
tctccaccctcgccccaaca

SEQ ID NO: 43308 - DNA, 23 bp, synthetic construct
  misc_feature 1..23: note = Synthetic Construct
  source 1..23: mol_type = other DNA
gttgttagcccagaaacgcaatg

SEQ ID NO: 43309 - DNA, 22 bp, synthetic construct
  misc_feature 1..22: note = Synthetic Construct
  source 1..22: mol_type = other DNA
cctgttggactctgctccattg

SEQ ID NO: 43310 - DNA, 24 bp, synthetic construct
  misc_feature 1..24: note = Synthetic Construct
  source 1..24: mol_type = other DNA
caaggttcttggaaaccacaacaa

SEQ ID NO: 43311 - DNA, 23 bp, synthetic construct
  misc_feature 1..23: note = Synthetic Construct
  source 1..23: mol_type = other DNA
agtagagagacaccctccagttt

SEQ ID NO: 43312 - DNA, 24 bp, synthetic construct
  misc_feature 1..24: note = Synthetic Construct
  source 1..24: mol_type = other DNA
gaaccctataggctcactccaaag

SEQ ID NO: 43313 - DNA, 21 bp, synthetic construct
  misc_feature 1..21: note = Synthetic Construct
  source 1..21: mol_type = other DNA
cccagccatgttggcatcaga

SEQ ID NO: 43314 - DNA, 24 bp, synthetic construct
  misc_feature 1..24: note = Synthetic Construct
  source 1..24: mol_type = other DNA
caggggaggttttactttcgcata

SEQ ID NO: 43315 - DNA, 20 bp, synthetic construct
  misc_feature 1..20: note = Synthetic Construct
  source 1..20: mol_type = other DNA
tcgacccgaggagggaccaa

SEQ ID NO: 43316 - DNA, 21 bp, synthetic construct
  misc_feature 1..21: note = Synthetic Construct
  source 1..21: mol_type = other DNA
atcgctgaggccagggcttac

SEQ ID NO: 43317 - DNA, 21 bp, synthetic construct
  misc_feature 1..21: note = Synthetic Construct
  source 1..21: mol_type = other DNA
aagcagggagacaggctgtga

SEQ ID NO: 43318 - DNA, 20 bp, synthetic construct
  misc_feature 1..20: note = Synthetic Construct
  source 1..20: mol_type = other DNA
caacggcagcgtcttcacta

SEQ ID NO: 43319 - DNA, 22 bp, synthetic construct
  misc_feature 1..22: note = Synthetic Construct
  source 1..22: mol_type = other DNA
ggcattgcggacacaggtctat

SEQ ID NO: 43320 - DNA, 26 bp, synthetic construct
  misc_feature 1..26: note = Synthetic Construct
  source 1..26: mol_type = other DNA
ctcctgtagtcaacaactgattgcat

SEQ ID NO: 43321 - DNA, 19 bp, synthetic construct
  misc_feature 1..19: note = Synthetic Construct
  source 1..19: mol_type = other DNA
cccgggtaagcctgcagta

SEQ ID NO: 43322 - DNA, 24 bp, synthetic construct
  misc_feature 1..24: note = Synthetic Construct
  source 1..24: mol_type = other DNA
ctccatggtttctggggttctttc

SEQ ID NO: 43323 - DNA, 22 bp, synthetic construct
  misc_feature 1..22: note = Synthetic Construct
  source 1..22: mol_type = other DNA
aggccactgagtaggacagtga

SEQ ID NO: 43324 - DNA, 21 bp, synthetic construct
  misc_feature 1..21: note = Synthetic Construct
  source 1..21: mol_type = other DNA
catgccaaccaagctgcaaag

SEQ ID NO: 43325 - DNA, 21 bp, synthetic construct
  misc_feature 1..21: note = Synthetic Construct
  source 1..21: mol_type = other DNA
gccctgtagcccacctcttta

SEQ ID NO: 43326 - DNA, 28 bp, synthetic construct
  misc_feature 1..28: note = Synthetic Construct
  source 1..28: mol_type = other DNA
ccagtacacagcagagctggtatttaag

SEQ ID NO: 43327 - DNA, 22 bp, synthetic construct
  misc_feature 1..22: note = Synthetic Construct
  source 1..22: mol_type = other DNA
ctcaacacaggatctggtccaa

SEQ ID NO: 43328 - DNA, 25 bp, synthetic construct
  misc_feature 1..25: note = Synthetic Construct
  source 1..25: mol_type = other DNA
gggctcaagagcttaggctgtttct

SEQ ID NO: 43329 - DNA, 23 bp, synthetic construct
  misc_feature 1..23: note = Synthetic Construct
  source 1..23: mol_type = other DNA
ggagcacacacacctgaaacttg

SEQ ID NO: 43330 - DNA, 20 bp, synthetic construct
  misc_feature 1..20: note = Synthetic Construct
  source 1..20: mol_type = other DNA
tgccagccatgcagtgtcaa

SEQ ID NO: 43331 - DNA, 21 bp, synthetic construct
  misc_feature 1..21: note = Synthetic Construct
  source 1..21: mol_type = other DNA
tcaacaatgccagcactcaca

SEQ ID NO: 43332 - DNA, 20 bp, synthetic construct
  misc_feature 1..20: note = Synthetic Construct
  source 1..20: mol_type = other DNA
aggaaccaggaggcatgtgt

SEQ ID NO: 43333 - DNA, 27 bp, synthetic construct
  misc_feature 1..27: note = Synthetic Construct
  source 1..27: mol_type = other DNA
cagagaggattgcatggatcttcatag

SEQ ID NO: 43334 - DNA, 25 bp, synthetic construct
  misc_feature 1..25: note = Synthetic Construct
  source 1..25: mol_type = other DNA
cctgtggtttctactgcttagagtt

SEQ ID NO: 43335 - DNA, 25 bp, synthetic construct
  misc_feature 1..25: note = Synthetic Construct
  source 1..25: mol_type = other DNA
gaaacctgaaaacgtgagcattagt

SEQ ID NO: 43336 - DNA, 22 bp, synthetic construct
  misc_feature 1..22: note = Synthetic Construct
  source 1..22: mol_type = other DNA
cagtaccctggactgtcagcaa

SEQ ID NO: 43337 - DNA, 26 bp, synthetic construct
  misc_feature 1..26: note = Synthetic Construct
  source 1..26: mol_type = other DNA
gtgaaaacgaggaaactgagatccaa

SEQ ID NO: 43338 - DNA, 22 bp, synthetic construct
  misc_feature 1..22: note = Synthetic Construct
  source 1..22: mol_type = other DNA
ctgtcattggggaggtttggaa

SEQ ID NO: 43339 - DNA, 21 bp, synthetic construct
  misc_feature 1..21: note = Synthetic Construct
  source 1..21: mol_type = other DNA
gggacagttggctgttaggtt

SEQ ID NO: 43340 - DNA, 22 bp, synthetic construct
  misc_feature 1..22: note = Synthetic Construct
  source 1..22: mol_type = other DNA
agagctcagctgccttccatag

SEQ ID NO: 43341 - DNA, 22 bp, synthetic construct
  misc_feature 1..22: note = Synthetic Construct
  source 1..22: mol_type = other DNA
cacgtccccagtttctctggaa

SEQ ID NO: 43342 - DNA, 24 bp, synthetic construct
  misc_feature 1..24: note = Synthetic Construct
  source 1..24: mol_type = other DNA
gtccactgattgttgagggctaga

SEQ ID NO: 43343 - DNA, 22 bp, synthetic construct
  misc_feature 1..22: note = Synthetic Construct
  source 1..22: mol_type = other DNA
ccacaccataaggctggagcta

SEQ ID NO: 43344 - DNA, 28 bp, synthetic construct
  misc_feature 1..28: note = Synthetic Construct
  source 1..28: mol_type = other DNA
cctgcctgaaaaattaagccatgacagt

SEQ ID NO: 43345 - DNA, 21 bp, synthetic construct
  misc_feature 1..21: note = Synthetic Construct
  source 1..21: mol_type = other DNA
ccccaataccacacactgcat

SEQ ID NO: 43346 - DNA, 25 bp, synthetic construct
  misc_feature 1..25: note = Synthetic Construct
  source 1..25: mol_type = other DNA
cagaggaacagaatgaaacctcagt

SEQ ID NO: 43347 - DNA, 23 bp, synthetic construct
  misc_feature 1..23: note = Synthetic Construct
  source 1..23: mol_type = other DNA
tgaatcgtgtcctggttgtgaag

SEQ ID NO: 43348 - DNA, 20 bp, synthetic construct
  misc_feature 1..20: note = Synthetic Construct
  source 1..20: mol_type = other DNA
ggctgcatgcaagaggattg

SEQ ID NO: 43349 - DNA, 19 bp, synthetic construct
  misc_feature 1..19: note = Synthetic Construct
  source 1..19: mol_type = other DNA
aacagaagcgcagccagaa

SEQ ID NO: 43350 - DNA, 24 bp, synthetic construct
  misc_feature 1..24: note = Synthetic Construct
  source 1..24: mol_type = other DNA
cctcagttaccgtctgcttacatc

SEQ ID NO: 43351 - DNA, 26 bp, synthetic construct
  misc_feature 1..26: note = Synthetic Construct
  source 1..26: mol_type = other DNA
ctccattacagatagcactcttcact

SEQ ID NO: 43352 - DNA, 21 bp, synthetic construct
  misc_feature 1..21: note = Synthetic Construct
  source 1..21: mol_type = other DNA
ccacaacccacagtcccttca

SEQ ID NO: 43353 - DNA, 25 bp, synthetic construct
  misc_feature 1..25: note = Synthetic Construct
  source 1..25: mol_type = other DNA
gatttggacctgatcagtcttgaca

SEQ ID NO: 43354 - DNA, 20 bp, synthetic construct
  misc_feature 1..20: note = Synthetic Construct
  source 1..20: mol_type = other DNA
tggactagtgcctgcctgtt

SEQ ID NO: 43355 - DNA, 23 bp, synthetic construct
  misc_feature 1..23: note = Synthetic Construct
  source 1..23: mol_type = other DNA
ccatctgtccctcttggtgaatg

SEQ ID NO: 43356 - DNA, 25 bp, synthetic construct
  misc_feature 1..25: note = Synthetic Construct
  source 1..25: mol_type = other DNA
gcatagcaaagtggtaagtttggaa

SEQ ID NO: 43357 - DNA, 23 bp, synthetic construct
  misc_feature 1..23: note = Synthetic Construct
  source 1..23: mol_type = other DNA
caatcctttatggcgcaggaatg

SEQ ID NO: 43358 - DNA, 25 bp, synthetic construct
  misc_feature 1..25: note = Synthetic Construct
  source 1..25: mol_type = other DNA
ctccaaaatctggtcacctcctttg

SEQ ID NO: 43359 - DNA, 21 bp, synthetic construct
  misc_feature 1..21: note = Synthetic Construct
  source 1..21: mol_type = other DNA
atctgcaggggcccagataca

SEQ ID NO: 43360 - DNA, 25 bp, synthetic construct
  misc_feature 1..25: note = Synthetic Construct
  source 1..25: mol_type = other DNA
cccatcaaaactcctgtctttggaa

SEQ ID NO: 43361 - DNA, 22 bp, synthetic construct
  misc_feature 1..22: note = Synthetic Construct
  source 1..22: mol_type = other DNA
gccaagcaagctttcccgaaca

SEQ ID NO: 43362 - DNA, 19 bp, synthetic construct
  misc_feature 1..19: note = Synthetic Construct
  source 1..19: mol_type = other DNA
cctgcactgtgggctggaa

SEQ ID NO: 43363 - DNA, 22 bp, synthetic construct
  misc_feature 1..22: note = Synthetic Construct
  source 1..22: mol_type = other DNA
aagtccaaagggcctgggtatc

SEQ ID NO: 43364 - DNA, 22 bp, synthetic construct
  misc_feature 1..22: note = Synthetic Construct
  source 1..22: mol_type = other DNA
ggaatcaccttcagcgcattac

SEQ ID NO: 43365 - DNA, 23 bp, synthetic construct
  misc_feature 1..23: note = Synthetic Construct
  source 1..23: mol_type = other DNA
ggagcaacatacagaggggattg

SEQ ID NO: 43366 - DNA, 20 bp, synthetic construct
  misc_feature 1..20: note = Synthetic Construct
  source 1..20: mol_type = other DNA
aaatggtgcctggggctgaa

SEQ ID NO: 43367 - DNA, 21 bp, synthetic construct
  misc_feature 1..21: note = Synthetic Construct
  source 1..21: mol_type = other DNA
gcccacaccacttcacctttg

SEQ ID NO: 43368 - DNA, 22 bp, synthetic construct
  misc_feature 1..22: note = Synthetic Construct
  source 1..22: mol_type = other DNA
aggggagcaggaaataggaaca

SEQ ID NO: 43369 - DNA, 23 bp, synthetic construct
  misc_feature 1..23: note = Synthetic Construct
  source 1..23: mol_type = other DNA
caggaagcctgagcaaagtaagt

SEQ ID NO: 43370 - DNA, 22 bp, synthetic construct
  misc_feature 1..22: note = Synthetic Construct
  source 1..22: mol_type = other DNA
gtgcaatgtcctagggctgagt

SEQ ID NO: 43371 - DNA, 19 bp, synthetic construct
  misc_feature 1..19: note = Synthetic Construct
  source 1..19: mol_type = other DNA
aggtggggtgtggaaggat

SEQ ID NO: 43372 - DNA, 24 bp, synthetic construct
  misc_feature 1..24: note = Synthetic Construct
  source 1..24: mol_type = other DNA
ccccagagatagcctggaaaccaa

SEQ ID NO: 43373 - DNA, 25 bp, synthetic construct
  misc_feature 1..25: note = Synthetic Construct
  source 1..25: mol_type = other DNA
ggatacagatgtgggactcaaagat

SEQ ID NO: 43374 - DNA, 21 bp, synthetic construct
  misc_feature 1..21: note = Synthetic Construct
  source 1..21: mol_type = other DNA
tcagagcccagggttcaagtt

SEQ ID NO: 43375 - DNA, 20 bp, synthetic construct
  misc_feature 1..20: note = Synthetic Construct
  source 1..20: mol_type = other DNA
ggctcccaccctccaaaaca

SEQ ID NO: 43376 - DNA, 20 bp, synthetic construct
  misc_feature 1..20: note = Synthetic Construct
  source 1..20: mol_type = other DNA
caagcagtgccagagcatgt

SEQ ID NO: 43377 - DNA, 24 bp, synthetic construct
  misc_feature 1..24: note = Synthetic Construct
  source 1..24: mol_type = other DNA
ggggacataaatgcacccttggaa

SEQ ID NO: 43378 - DNA, 26 bp, synthetic construct
  misc_feature 1..26: note = Synthetic Construct
  source 1..26: mol_type = other DNA
cttagtacttgagacattggctgtca

SEQ ID NO: 43379 - DNA, 26 bp, synthetic construct
  misc_feature 1..26: note = Synthetic Construct
  source 1..26: mol_type = other DNA
gggtaccagaggcatgattagccata

SEQ ID NO: 43380 - DNA, 23 bp, synthetic construct
  misc_feature 1..23: note = Synthetic Construct
  source 1..23: mol_type = other DNA
gggaatttacaccctgcagttga

SEQ ID NO: 43381 - DNA, 23 bp, synthetic construct
  misc_feature 1..23: note = Synthetic Construct
  source 1..23: mol_type = other DNA
aggctgggaaactcaggtttaag

SEQ ID NO: 43382 - DNA, 22 bp, synthetic construct
  misc_feature 1..22: note = Synthetic Construct
  source 1..22: mol_type = other DNA
gcttctgccaatgggcttgagt

SEQ ID NO: 43383 - DNA, 25 bp, synthetic construct
  misc_feature 1..25: note = Synthetic Construct
  source 1..25: mol_type = other DNA
cctgggagttgcttaattgccagat

SEQ ID NO: 43384 - DNA, 25 bp, synthetic construct
  misc_feature 1..25: note = Synthetic Construct
  source 1..25: mol_type = other DNA
ttctctttctgttttggctgggata

SEQ ID NO: 43385 - DNA, 23 bp, synthetic construct
  misc_feature 1..23: note = Synthetic Construct
  source 1..23: mol_type = other DNA
gccccatcaatcctagtcagttg

SEQ ID NO: 43386 - DNA, 22 bp, synthetic construct
  misc_feature 1..22: note = Synthetic Construct
  source 1..22: mol_type = other DNA
ggcatccgtcattgccaaggta

SEQ ID NO: 43387 - DNA, 21 bp, synthetic construct
  misc_feature 1..21: note = Synthetic Construct
  source 1..21: mol_type = other DNA
tggcttgaggccaggagtttg

SEQ ID NO: 43388 - DNA, 23 bp, synthetic construct
  misc_feature 1..23: note = Synthetic Construct
  source 1..23: mol_type = other DNA
caaagcccatttgtagcacactt

SEQ ID NO: 43389 - DNA, 25 bp, synthetic construct
  misc_feature 1..25: note = Synthetic Construct
  source 1..25: mol_type = other DNA
cagaaaacacaggggctagaacaac

SEQ ID NO: 43390 - DNA, 19 bp, synthetic construct
  misc_feature 1..19: note = Synthetic Construct
  source 1..19: mol_type = other DNA
tgcagcctgtgacgtgtgt

SEQ ID NO: 43391 - DNA, 23 bp, synthetic construct
  misc_feature 1..23: note = Synthetic Construct
  source 1..23: mol_type = other DNA
gcagttagcattgtcccaaccaa

SEQ ID NO: 43392 - DNA, 20 bp, synthetic construct
  misc_feature 1..20: note = Synthetic Construct
  source 1..20: mol_type = other DNA
tagggcaggcaggactggtt

SEQ ID NO: 43393 - DNA, 22 bp, synthetic construct
  misc_feature 1..22: note = Synthetic Construct
  source 1..22: mol_type = other DNA
tgtgcttaaagagcctgagcaa

SEQ ID NO: 43394 - DNA, 22 bp, synthetic construct
  misc_feature 1..22: note = Synthetic Construct
  source 1..22: mol_type = other DNA
ccctgtgatgggccctagtttt

SEQ ID NO: 43395 - DNA, 24 bp, synthetic construct
  misc_feature 1..24: note = Synthetic Construct
  source 1..24: mol_type = other DNA
tgttgggctaaggctaaggttaag

SEQ ID NO: 43396 - DNA, 21 bp, synthetic construct
  misc_feature 1..21: note = Synthetic Construct
  source 1..21: mol_type = other DNA
ctggaggaaattgccctgctt

SEQ ID NO: 43397 - DNA, 20 bp, synthetic construct
  misc_feature 1..20: note = Synthetic Construct
  source 1..20: mol_type = other DNA
tgtgagtcgtgcggtgactt

SEQ ID NO: 43398 - DNA, 23 bp, synthetic construct
  misc_feature 1..23: note = Synthetic Construct
  source 1..23: mol_type = other DNA
gtctgcatttgccttttgctgaa

SEQ ID NO: 43399 - DNA, 22 bp, synthetic construct
  misc_feature 1..22: note = Synthetic Construct
  source 1..22: mol_type = other DNA
cacagacgagtccctctcaatg

SEQ ID NO: 43400 - DNA, 24 bp, synthetic construct
  misc_feature 1..24: note = Synthetic Construct
  source 1..24: mol_type = other DNA
ggactcttgcaattctaggcaaag

SEQ ID NO: 43401 - DNA, 25 bp, synthetic construct
  misc_feature 1..25: note = Synthetic Construct
  source 1..25: mol_type = other DNA
tgacaaaaggaaggaacaacctcat

SEQ ID NO: 43402 - DNA, 22 bp, synthetic construct
  misc_feature 1..22: note = Synthetic Construct
  source 1..22: mol_type = other DNA
cttcccacaaaccccacaatga

SEQ ID NO: 43403 - DNA, 24 bp, synthetic construct
  misc_feature 1..24: note = Synthetic Construct
  source 1..24: mol_type = other DNA
tttccactcttcaacaggacttga

SEQ ID NO: 43404 - DNA, 25 bp, synthetic construct
  misc_feature 1..25: note = Synthetic Construct
  source 1..25: mol_type = other DNA
cactggaatcctatttccacagtga

SEQ ID NO: 43405 - DNA, 22 bp, synthetic construct
  misc_feature 1..22: note = Synthetic Construct
  source 1..22: mol_type = other DNA
ggagcaggattcagggaagaca

SEQ ID NO: 43406 - DNA, 22 bp, synthetic construct
  misc_feature 1..22: note = Synthetic Construct
  source 1..22: mol_type = other DNA
gctgaacatctgtgctggttga

SEQ ID NO: 43407 - DNA, 21 bp, synthetic construct
  misc_feature 1..21: note = Synthetic Construct
  source 1..21: mol_type = other DNA
ctgtcctgtcccaagtgcttt

SEQ ID NO: 43408 - DNA, 22 bp, synthetic construct
  misc_feature 1..22: note = Synthetic Construct
  source 1..22: mol_type = other DNA
agtgggaaggccagggataaag

SEQ ID NO: 43409 - DNA, 22 bp, synthetic construct
  misc_feature 1..22: note = Synthetic Construct
  source 1..22: mol_type = other DNA
gacaggaaactcctcagtgcaa

SEQ ID NO: 43410 - DNA, 22 bp, synthetic construct
  misc_feature 1..22: note = Synthetic Construct
  source 1..22: mol_type = other DNA
gaggtaatgcctagctgcaaca

SEQ ID NO: 43411 - DNA, 24 bp, synthetic construct
  misc_feature 1..24: note = Synthetic Construct
  source 1..24: mol_type = other DNA
tcgagcctatccattctagcttct

SEQ ID NO: 43412 - DNA, 19 bp, synthetic construct
  misc_feature 1..19: note = Synthetic Construct
  source 1..19: mol_type = other DNA
tgtgtgcctgccaggtagt

SEQ ID NO: 43413 - DNA, 20 bp, synthetic construct
  misc_feature 1..20: note = Synthetic Construct
  source 1..20: mol_type = other DNA
taccctcgtagccgcaagta

SEQ ID NO: 43414 - DNA, 25 bp, synthetic construct
  misc_feature 1..25: note = Synthetic Construct
  source 1..25: mol_type = other DNA
gaagactgcttcaaaaaggcagatg

SEQ ID NO: 43415 - DNA, 22 bp, synthetic construct
  misc_feature 1..22: note = Synthetic Construct
  source 1..22: mol_type = other DNA
actgcaggagtgactgagattg

SEQ ID NO: 43416 - DNA, 22 bp, synthetic construct
  misc_feature 1..22: note = Synthetic Construct
  source 1..22: mol_type = other DNA
gcaatccctggttcagcagaca

SEQ ID NO: 43417 - DNA, 20 bp, synthetic construct
  misc_feature 1..20: note = Synthetic Construct
  source 1..20: mol_type = other DNA
gagcaagccctggaaacagt

SEQ ID NO: 43418 - DNA, 24 bp, synthetic construct
  misc_feature 1..24: note = Synthetic Construct
  source 1..24: mol_type = other DNA
agtaagggaaggaaaggccaaatg

SEQ ID NO: 43419 - DNA, 20 bp, synthetic construct
  misc_feature 1..20: note = Synthetic Construct
  source 1..20: mol_type = other DNA
cagcaagccaagagctggtt

SEQ ID NO: 43420 - DNA, 26 bp, synthetic construct
  misc_feature 1..26: note = Synthetic Construct
  source 1..26: mol_type = other DNA
cacatgaccccatactgtcttcaaac

SEQ ID NO: 43421 - DNA, 21 bp, synthetic construct
  misc_feature 1..21: note = Synthetic Construct
  source 1..21: mol_type = other DNA
atggctgccctccctttgtgt

SEQ ID NO: 43422 - DNA, 26 bp, synthetic construct
  misc_feature 1..26: note = Synthetic Construct
  source 1..26: mol_type = other DNA
cacttttaggggaacttggtggatct

SEQ ID NO: 43423 - DNA, 27 bp, synthetic construct
  misc_feature 1..27: note = Synthetic Construct
  source 1..27: mol_type = other DNA
cagtactccatccagatctgacttcat

SEQ ID NO: 43424 - DNA, 25 bp, synthetic construct
  misc_feature 1..25: note = Synthetic Construct
  source 1..25: mol_type = other DNA
cactctgtccaagtcctgctacatc

SEQ ID NO: 43425 - DNA, 26 bp, synthetic construct
  misc_feature 1..26: note = Synthetic Construct
  source 1..26: mol_type = other DNA
gtgatagaaatccttgctcagagagt

SEQ ID NO: 43426 - DNA, 23 bp, synthetic construct
  misc_feature 1..23: note = Synthetic Construct
  source 1..23: mol_type = other DNA
ggtctcacaagctctgcttccat

SEQ ID NO: 43427 - DNA, 27 bp, synthetic construct
  misc_feature 1..27: note = Synthetic Construct
  source 1..27: mol_type = other DNA
tgatagatcgtgtggtgtaaaggttag

SEQ ID NO: 43428 - DNA, 19 bp, synthetic construct
  misc_feature 1..19: note = Synthetic Construct
  source 1..19: mol_type = other DNA
cagctcacagtgcccagaa

SEQ ID NO: 43429 - DNA, 19 bp, synthetic construct
  misc_feature 1..19: note = Synthetic Construct
  source 1..19: mol_type = other DNA
caggcacagcctggagaac

SEQ ID NO: 43430 - DNA, 22 bp, synthetic construct
  misc_feature 1..22: note = Synthetic Construct
  source 1..22: mol_type = other DNA
aaacttcccatggacagagcaa

SEQ ID NO: 43431 - DNA, 23 bp, synthetic construct
  misc_feature 1..23: note = Synthetic Construct
  source 1..23: mol_type = other DNA
ggcactgaagttaggtggagagt

SEQ ID NO: 43432 - DNA, 20 bp, synthetic construct
  misc_feature 1..20: note = Synthetic Construct
  source 1..20: mol_type = other DNA
tggcactgcagccccaataa

SEQ ID NO: 43433 - DNA, 20 bp, synthetic construct
  misc_feature 1..20: note = Synthetic Construct
  source 1..20: mol_type = other DNA
tgggcacagatgcagtgttg

SEQ ID NO: 43434 - DNA, 23 bp, synthetic construct
  misc_feature 1..23: note = Synthetic Construct
  source 1..23: mol_type = other DNA
ctagaatactccccaggctcact

SEQ ID NO: 43435 - DNA, 20 bp, synthetic construct
  misc_feature 1..20: note = Synthetic Construct
  source 1..20: mol_type = other DNA
accttgcctctggggactct

SEQ ID NO: 43436 - DNA, 22 bp, synthetic construct
  misc_feature 1..22: note = Synthetic Construct
  source 1..22: mol_type = other DNA
ggaacacagaaagcctggaact

SEQ ID NO: 43437 - DNA, 27 bp, synthetic construct
  misc_feature 1..27: note = Synthetic Construct
  source 1..27: mol_type = other DNA
gttgtaattctccaatcccaactgtca

SEQ ID NO: 43438 - DNA, 20 bp, synthetic construct
  misc_feature 1..20: note = Synthetic Construct
  source 1..20: mol_type = other DNA
tcaagtcggggtgggaagaa

SEQ ID NO: 43439 - DNA, 24 bp, synthetic construct
  misc_feature 1..24: note = Synthetic Construct
  source 1..24: mol_type = other DNA
cagaaaagtgactggaaagcaagt

SEQ ID NO: 43440 - DNA, 23 bp, synthetic construct
  misc_feature 1..23: note = Synthetic Construct
  source 1..23: mol_type = other DNA
gtctttcccaaagcacaggatga

SEQ ID NO: 43441 - DNA, 25 bp, synthetic construct
  misc_feature 1..25: note = Synthetic Construct
  source 1..25: mol_type = other DNA
tctgatgctgcttggaatagtttgt

SEQ ID NO: 43442 - DNA, 23 bp, synthetic construct
  misc_feature 1..23: note = Synthetic Construct
  source 1..23: mol_type = other DNA
gcacgcttttaatcagggtgtag

SEQ ID NO: 43443 - DNA, 20 bp, synthetic construct
  misc_feature 1..20: note = Synthetic Construct
  source 1..20: mol_type = other DNA
tgggaggaggacagccacaa

SEQ ID NO: 43444 - DNA, 20 bp, synthetic construct
  misc_feature 1..20: note = Synthetic Construct
  source 1..20: mol_type = other DNA
cccagcacccactccaattt

SEQ ID NO: 43445 - DNA, 27 bp, synthetic construct
  misc_feature 1..27: note = Synthetic Construct
  source 1..27: mol_type = other DNA
cacaggttaccttaatcaggcttggaa

SEQ ID NO: 43446 - DNA, 21 bp, synthetic construct
  misc_feature 1..21: note = Synthetic Construct
  source 1..21: mol_type = other DNA
ggtggcaatgacagccaaaag

SEQ ID NO: 43447 - DNA, 25 bp, synthetic construct
  misc_feature 1..25: note = Synthetic Construct
  source 1..25: mol_type = other DNA
cactcacatggttgttggctgttag

SEQ ID NO: 43448 - DNA, 24 bp, synthetic construct
  misc_feature 1..24: note = Synthetic Construct
  source 1..24: mol_type = other DNA
ctttggcctgtatattgggtggta

SEQ ID NO: 43449 - DNA, 22 bp, synthetic construct
  misc_feature 1..22: note = Synthetic Construct
  source 1..22: mol_type = other DNA
ctccaaatgtcagcagggtgtt

SEQ ID NO: 43450 - DNA, 23 bp, synthetic construct
  misc_feature 1..23: note = Synthetic Construct
  source 1..23: mol_type = other DNA
cttggcttcagagtttccaggta

SEQ ID NO: 43451 - DNA, 21 bp, synthetic construct
  misc_feature 1..21: note = Synthetic Construct
  source 1..21: mol_type = other DNA
agctggcaaggcaatttggat

SEQ ID NO: 43452 - DNA, 24 bp, synthetic construct
  misc_feature 1..24: note = Synthetic Construct
  source 1..24: mol_type = other DNA
agaacaacacaggaatgtctgctt

SEQ ID NO: 43453 - DNA, 20 bp, synthetic construct
  misc_feature 1..20: note = Synthetic Construct
  source 1..20: mol_type = other DNA
cgcttgtgctaccacctgta

SEQ ID NO: 43454 - DNA, 24 bp, synthetic construct
  misc_feature 1..24: note = Synthetic Construct
  source 1..24: mol_type = other DNA
ccaaggaacctgacaattgctgaa

SEQ ID NO: 43455 - DNA, 24 bp, synthetic construct
  misc_feature 1..24: note = Synthetic Construct
  source 1..24: mol_type = other DNA
cactgtgtgtgtccttcatcttgt

SEQ ID NO: 43456 - DNA, 25 bp, synthetic construct
  misc_feature 1..25: note = Synthetic Construct
  source 1..25: mol_type = other DNA
ccacagcccattttaaccctacttg

SEQ ID NO: 43457 - DNA, 23 bp, synthetic construct
  misc_feature 1..23: note = Synthetic Construct
  source 1..23: mol_type = other DNA
ggaagggaaggttgagtccatga

SEQ ID NO: 43458 - DNA, 20 bp, synthetic construct
  misc_feature 1..20: note = Synthetic Construct
  source 1..20: mol_type = other DNA
acccatagggtgccgaactt

SEQ ID NO: 43459 - DNA, 18 bp, synthetic construct
  misc_feature 1..18: note = Synthetic Construct
  source 1..18: mol_type = other DNA
agcaggcccagctcaaac

SEQ ID NO: 43460 - DNA, 24 bp, synthetic construct
  misc_feature 1..24: note = Synthetic Construct
  source 1..24: mol_type = other DNA
ctgtgtgaaatcctccccaagaag

SEQ ID NO: 43461 - DNA, 23 bp, synthetic construct
  misc_feature 1..23: note = Synthetic Construct
  source 1..23: mol_type = other DNA
gagtcctgatgtgtggtgcaatc

SEQ ID NO: 43462 - DNA, 19 bp, synthetic construct
  misc_feature 1..19: note = Synthetic Construct
  source 1..19: mol_type = other DNA
actgctgaggcagcaacaa

SEQ ID NO: 43463 - DNA, 25 bp, synthetic construct
  misc_feature 1..25: note = Synthetic Construct
  source 1..25: mol_type = other DNA
ggatttgctaccccagtgtttgagt

SEQ ID NO: 43464 - DNA, 21 bp, synthetic construct
  misc_feature 1..21: note = Synthetic Construct
  source 1..21: mol_type = other DNA
tcccttgcccactgggagaaa

SEQ ID NO: 43465 - DNA, 24 bp, synthetic construct
  misc_feature 1..24: note = Synthetic Construct
  source 1..24: mol_type = other DNA
gcaagctgtggctgaatagacaac

SEQ ID NO: 43466 - DNA, 24 bp, synthetic construct
  misc_feature 1..24: note = Synthetic Construct
  source 1..24: mol_type = other DNA
gtgctcttcactctgtcaccaact

SEQ ID NO: 43467 - DNA, 23 bp, synthetic construct
  misc_feature 1..23: note = Synthetic Construct
  source 1..23: mol_type = other DNA
tccacagcttcgaaactcttcat

SEQ ID NO: 43468 - DNA, 23 bp, synthetic construct
  misc_feature 1..23: note = Synthetic Construct
  source 1..23: mol_type = other DNA
gggatttgctaccctccttctca

SEQ ID NO: 43469 - DNA, 20 bp, synthetic construct
  misc_feature 1..20: note = Synthetic Construct
  source 1..20: mol_type = other DNA
gcctcctaggctgtgctgaa

SEQ ID NO: 43470 - DNA, 22 bp, synthetic construct
  misc_feature 1..22: note = Synthetic Construct
  source 1..22: mol_type = other DNA
tgtgctccccgtaacctctaca

SEQ ID NO: 43471 - DNA, 20 bp, synthetic construct
  misc_feature 1..20: note = Synthetic Construct
  source 1..20: mol_type = other DNA
ggactcagcgtcctctcctt

SEQ ID NO: 43472 - DNA, 26 bp, synthetic construct
  misc_feature 1..26: note = Synthetic Construct
  source 1..26: mol_type = other DNA
gcaagttcatgtctgcttggatgtag

SEQ ID NO: 43473 - DNA, 30 bp, synthetic construct
  misc_feature 1..30: note = Synthetic Construct
  source 1..30: mol_type = other DNA
ctcttgaaaatctatctacagggctaccaa

SEQ ID NO: 43474 - DNA, 23 bp, synthetic construct
  misc_feature 1..23: note = Synthetic Construct
  source 1..23: mol_type = other DNA
cacatggcttttggagacgattc

SEQ ID NO: 43475 - DNA, 22 bp, synthetic construct
  misc_feature 1..22: note = Synthetic Construct
  source 1..22: mol_type = other DNA
ggattgacccttccccagttac

SEQ ID NO: 43476 - DNA, 21 bp, synthetic construct
  misc_feature 1..21: note = Synthetic Construct
  source 1..21: mol_type = other DNA
gcatgttccttgggtgggaat

SEQ ID NO: 43477 - DNA, 18 bp, synthetic construct
  misc_feature 1..18: note = Synthetic Construct
  source 1..18: mol_type = other DNA
atgtggcaggcccagtga

SEQ ID NO: 43478 - DNA, 22 bp, synthetic construct
  misc_feature 1..22: note = Synthetic Construct
  source 1..22: mol_type = other DNA
gcctgagttgacaggcggataa

SEQ ID NO: 43479 - DNA, 22 bp, synthetic construct
  misc_feature 1..22: note = Synthetic Construct
  source 1..22: mol_type = other DNA
gctctgttagggcagaaaccat

SEQ ID NO: 43480 - DNA, 25 bp, synthetic construct
  misc_feature 1..25: note = Synthetic Construct
  source 1..25: mol_type = other DNA
cccattgatacagcaccttggatga

SEQ ID NO: 43481 - DNA, 26 bp, synthetic construct
  misc_feature 1..26: note = Synthetic Construct
  source 1..26: mol_type = other DNA
ctacttttcaaatcctccgacctaca

SEQ ID NO: 43482 - DNA, 23 bp, synthetic construct
  misc_feature 1..23: note = Synthetic Construct
  source 1..23: mol_type = other DNA
ggtggtttgcaaggatgggttca

SEQ ID NO: 43483 - DNA, 25 bp, synthetic construct
  misc_feature 1..25: note = Synthetic Construct
  source 1..25: mol_type = other DNA
gctccagatcccactcatagcattg

SEQ ID NO: 43484 - DNA, 20 bp, synthetic construct
  misc_feature 1..20: note = Synthetic Construct
  source 1..20: mol_type = other DNA
attcccacacgccagcagaa

SEQ ID NO: 43485 - DNA, 24 bp, synthetic construct
  misc_feature 1..24: note = Synthetic Construct
  source 1..24: mol_type = other DNA
gtcaacatacatagggccagaaca

SEQ ID NO: 43486 - DNA, 24 bp, synthetic construct
  misc_feature 1..24: note = Synthetic Construct
  source 1..24: mol_type = other DNA
aaaactgacagggcttgatctttg

SEQ ID NO: 43487 - DNA, 22 bp, synthetic construct
  misc_feature 1..22: note = Synthetic Construct
  source 1..22: mol_type = other DNA
ggaaggcacatggggcttttgt

SEQ ID NO: 43488 - DNA, 22 bp, synthetic construct
  misc_feature 1..22: note = Synthetic Construct
  source 1..22: mol_type = other DNA
ccagcctttggagacctgtcaa

SEQ ID NO: 43489 - DNA, 21 bp, synthetic construct
  misc_feature 1..21: note = Synthetic Construct
  source 1..21: mol_type = other DNA
tcaaagtccaggtgggtcaga

SEQ ID NO: 43490 - DNA, 18 bp, synthetic construct
  misc_feature 1..18: note = Synthetic Construct
  source 1..18: mol_type = other DNA
aagccaggcgctcactca

SEQ ID NO: 43491 - DNA, 20 bp, synthetic construct
  misc_feature 1..20: note = Synthetic Construct
  source 1..20: mol_type = other DNA
cctgggcttccgtgttctga

SEQ ID NO: 43492 - DNA, 21 bp, synthetic construct
  misc_feature 1..21: note = Synthetic Construct
  source 1..21: mol_type = other DNA
gggcatgggtgtggaatgaca

SEQ ID NO: 43493 - DNA, 22 bp, synthetic construct
  misc_feature 1..22: note = Synthetic Construct
  source 1..22: mol_type = other DNA
cacgtaacctctgccaccagat

SEQ ID NO: 43494 - DNA, 22 bp, synthetic construct
  misc_feature 1..22: note = Synthetic Construct
  source 1..22: mol_type = other DNA
ccaccatacccaacctcagcat

SEQ ID NO: 43495 - DNA, 19 bp, synthetic construct
  misc_feature 1..19: note = Synthetic Construct
  source 1..19: mol_type = other DNA
tggagtgctggagggcttt

SEQ ID NO: 43496 - DNA, 25 bp, synthetic construct
  misc_feature 1..25: note = Synthetic Construct
  source 1..25: mol_type = other DNA
tggtccatatgcagatccagtaaag

SEQ ID NO: 43497 - DNA, 24 bp, synthetic construct
  misc_feature 1..24: note = Synthetic Construct
  source 1..24: mol_type = other DNA
ccatgcatttttaggcaccagttc

SEQ ID NO: 43498 - DNA, 24 bp, synthetic construct
  misc_feature 1..24: note = Synthetic Construct
  source 1..24: mol_type = other DNA
ccaacaaaagctggtttcccacat

SEQ ID NO: 43499 - DNA, 26 bp, synthetic construct
  misc_feature 1..26: note = Synthetic Construct
  source 1..26: mol_type = other DNA
ggggataaaataggagcaaaccagat

SEQ ID NO: 43500 - DNA, 25 bp, synthetic construct
  misc_feature 1..25: note = Synthetic Construct
  source 1..25: mol_type = other DNA
cagaagttccactgatagcttgtga

SEQ ID NO: 43501 - DNA, 19 bp, synthetic construct
  misc_feature 1..19: note = Synthetic Construct
  source 1..19: mol_type = other DNA
taggcggccagccatctct

SEQ ID NO: 43502 - DNA, 18 bp, synthetic construct
  misc_feature 1..18: note = Synthetic Construct
  source 1..18: mol_type = other DNA
tggtggtgggtgcagaga

SEQ ID NO: 43503 - DNA, 21 bp, synthetic construct
  misc_feature 1..21: note = Synthetic Construct
  source 1..21: mol_type = other DNA
tggggctgccgatctcactaa

SEQ ID NO: 43504 - DNA, 22 bp, synthetic construct
  misc_feature 1..22: note = Synthetic Construct
  source 1..22: mol_type = other DNA
agacatgttccctctccccaaa

SEQ ID NO: 43505 - DNA, 20 bp, synthetic construct
  misc_feature 1..20: note = Synthetic Construct
  source 1..20: mol_type = other DNA
actgcatgccgtggttcttc

SEQ ID NO: 43506 - DNA, 26 bp, synthetic construct
  misc_feature 1..26: note = Synthetic Construct
  source 1..26: mol_type = other DNA
gggagtggagtatttatgtccagtga

SEQ ID NO: 43507 - DNA, 19 bp, synthetic construct
  misc_feature 1..19: note = Synthetic Construct
  source 1..19: mol_type = other DNA
atcactggagcgcttgctt

SEQ ID NO: 43508 - DNA, 23 bp, synthetic construct
  misc_feature 1..23: note = Synthetic Construct
  source 1..23: mol_type = other DNA
ccaaagatcatgccaggagaaga

SEQ ID NO: 43509 - DNA, 27 bp, synthetic construct
  misc_feature 1..27: note = Synthetic Construct
  source 1..27: mol_type = other DNA
ccatttccaggtaaaacagagggtatg

SEQ ID NO: 43510 - DNA, 26 bp, synthetic construct
  misc_feature 1..26: note = Synthetic Construct
  source 1..26: mol_type = other DNA
cagtcaatacctgtctgacccaaatc

SEQ ID NO: 43511 - DNA, 22 bp, synthetic construct
  misc_feature 1..22: note = Synthetic Construct
  source 1..22: mol_type = other DNA
aagatcggactggggaggtgtt

SEQ ID NO: 43512 - DNA, 26 bp, synthetic construct
  misc_feature 1..26: note = Synthetic Construct
  source 1..26: mol_type = other DNA
ggttgtgattccatcaaactcgctaa

SEQ ID NO: 43513 - DNA, 21 bp, synthetic construct
  misc_feature 1..21: note = Synthetic Construct
  source 1..21: mol_type = other DNA
gctgcctgggatttgaaggat

SEQ ID NO: 43514 - DNA, 20 bp, synthetic construct
  misc_feature 1..20: note = Synthetic Construct
  source 1..20: mol_type = other DNA
ctgtgggcccaattcccatt

SEQ ID NO: 43515 - DNA, 26 bp, synthetic construct
  misc_feature 1..26: note = Synthetic Construct
  source 1..26: mol_type = other DNA
ggcacagtaaacttgaaccagagcaa

SEQ ID NO: 43516 - DNA, 26 bp, synthetic construct
  misc_feature 1..26: note = Synthetic Construct
  source 1..26: mol_type = other DNA
ggttattctacaaacaccccttcact

SEQ ID NO: 43517 - DNA, 26 bp, synthetic construct
  misc_feature 1..26: note = Synthetic Construct
  source 1..26: mol_type = other DNA
ggacatatgtggaaggcaaacgtaag

SEQ ID NO: 43518 - DNA, 20 bp, synthetic construct
  misc_feature 1..20: note = Synthetic Construct
  source 1..20: mol_type = other DNA
agagcaggaaggccagtgta

SEQ ID NO: 43519 - DNA, 20 bp, synthetic construct
  misc_feature 1..20: note = Synthetic Construct
  source 1..20: mol_type = other DNA
tcagggtgatcagccagcta

SEQ ID NO: 43520 - DNA, 23 bp, synthetic construct
  misc_feature 1..23: note = Synthetic Construct
  source 1..23: mol_type = other DNA
ggtcactatgtggcaaagcagtt

SEQ ID NO: 43521 - DNA, 21 bp, synthetic construct
  misc_feature 1..21: note = Synthetic Construct
  source 1..21: mol_type = other DNA
ggctggcctaaaagggattct

SEQ ID NO: 43522 - DNA, 24 bp, synthetic construct
  misc_feature 1..24: note = Synthetic Construct
  source 1..24: mol_type = other DNA
acatgatccacaacctttgacaac

SEQ ID NO: 43523 - DNA, 26 bp, synthetic construct
  misc_feature 1..26: note = Synthetic Construct
  source 1..26: mol_type = other DNA
gctgaacaggaactaatcatcaccat

SEQ ID NO: 43524 - DNA, 22 bp, synthetic construct
  misc_feature 1..22: note = Synthetic Construct
  source 1..22: mol_type = other DNA
agggaggatcactcctgcatct

SEQ ID NO: 43525 - DNA, 22 bp, synthetic construct
  misc_feature 1..22: note = Synthetic Construct
  source 1..22: mol_type = other DNA
tcactcctcgaacctgttctct

SEQ ID NO: 43526 - DNA, 22 bp, synthetic construct
  misc_feature 1..22: note = Synthetic Construct
  source 1..22: mol_type = other DNA
gtctgctatgagtctggtgctt

SEQ ID NO: 43527 - DNA, 20 bp, synthetic construct
  misc_feature 1..20: note = Synthetic Construct
  source 1..20: mol_type = other DNA
ctggcaaagcgtgcttcact

SEQ ID NO: 43528 - DNA, 20 bp, synthetic construct
  misc_feature 1..20: note = Synthetic Construct
  source 1..20: mol_type = other DNA
ggagtgcagtagtgcgtcat

SEQ ID NO: 43529 - DNA, 24 bp, synthetic construct
  misc_feature 1..24: note = Synthetic Construct
  source 1..24: mol_type = other DNA
ccccacctagaatgtggtaactgt

SEQ ID NO: 43530 - DNA, 21 bp, synthetic construct
  misc_feature 1..21: note = Synthetic Construct
  source 1..21: mol_type = other DNA
ccccagcagaggtgtgtttca

SEQ ID NO: 43531 - DNA, 22 bp, synthetic construct
  misc_feature 1..22: note = Synthetic Construct
  source 1..22: mol_type = other DNA
cccaccctagcctgatgacaaa

SEQ ID NO: 43532 - DNA, 26 bp, synthetic construct
  misc_feature 1..26: note = Synthetic Construct
  source 1..26: mol_type = other DNA
ccctgaacattgctattgctcccatt

SEQ ID NO: 43533 - DNA, 21 bp, synthetic construct
  misc_feature 1..21: note = Synthetic Construct
  source 1..21: mol_type = other DNA
aatgcacagtccccgcacaac

SEQ ID NO: 43534 - DNA, 22 bp, synthetic construct
  misc_feature 1..22: note = Synthetic Construct
  source 1..22: mol_type = other DNA
ggtggtcaggtggtggtaaatg

SEQ ID NO: 43535 - DNA, 26 bp, synthetic construct
  misc_feature 1..26: note = Synthetic Construct
  source 1..26: mol_type = other DNA
gaaagttgattcccttacagctgagt

SEQ ID NO: 43536 - DNA, 28 bp, synthetic construct
  misc_feature 1..28: note = Synthetic Construct
  source 1..28: mol_type = other DNA
ggtcctggcttagtaagatgacttccaa

SEQ ID NO: 43537 - DNA, 26 bp, synthetic construct
  misc_feature 1..26: note = Synthetic Construct
  source 1..26: mol_type = other DNA
agtcagaaagagaagttggtgacatc

SEQ ID NO: 43538 - DNA, 21 bp, synthetic construct
  misc_feature 1..21: note = Synthetic Construct
  source 1..21: mol_type = other DNA
tcccagaacagccctgacaga

SEQ ID NO: 43539 - DNA, 19 bp, synthetic construct
  misc_feature 1..19: note = Synthetic Construct
  source 1..19: mol_type = other DNA
tgaggggcgagacccagat

SEQ ID NO: 43540 - DNA, 23 bp, synthetic construct
  misc_feature 1..23: note = Synthetic Construct
  source 1..23: mol_type = other DNA
atcagcttgtgtgggaacttaca

SEQ ID NO: 43541 - DNA, 21 bp, synthetic construct
  misc_feature 1..21: note = Synthetic Construct
  source 1..21: mol_type = other DNA
ccacttccaggcgtttgttca

SEQ ID NO: 43542 - DNA, 23 bp, synthetic construct
  misc_feature 1..23: note = Synthetic Construct
  source 1..23: mol_type = other DNA
agcctgcaagtacattactgctt

SEQ ID NO: 43543 - DNA, 23 bp, synthetic construct
  misc_feature 1..23: note = Synthetic Construct
  source 1..23: mol_type = other DNA
acacacacatggtccagaagttg

SEQ ID NO: 43544 - DNA, 28 bp, synthetic construct
  misc_feature 1..28: note = Synthetic Construct
  source 1..28: mol_type = other DNA
gctttggaaagctacatccaagtcattg

SEQ ID NO: 43545 - DNA, 22 bp, synthetic construct
  misc_feature 1..22: note = Synthetic Construct
  source 1..22: mol_type = other DNA
caggtggttcatgctggtgttg

SEQ ID NO: 43546 - DNA, 20 bp, synthetic construct
  misc_feature 1..20: note = Synthetic Construct
  source 1..20: mol_type = other DNA
cccaacccaaggtggtcagt

SEQ ID NO: 43547 - DNA, 23 bp, synthetic construct
  misc_feature 1..23: note = Synthetic Construct
  source 1..23: mol_type = other DNA
ggggcaactctgaaggacctttt

SEQ ID NO: 43548 - DNA, 23 bp, synthetic construct
  misc_feature 1..23: note = Synthetic Construct
  source 1..23: mol_type = other DNA
ccactgggaatccaggagcattg

SEQ ID NO: 43549 - DNA, 22 bp, synthetic construct
  misc_feature 1..22: note = Synthetic Construct
  source 1..22: mol_type = other DNA
ctggaggtcaggtccaatgtct

SEQ ID NO: 43550 - DNA, 20 bp, synthetic construct
  misc_feature 1..20: note = Synthetic Construct
  source 1..20: mol_type = other DNA
tgagggagggagcccggttt

SEQ ID NO: 43551 - DNA, 29 bp, synthetic construct
  misc_feature 1..29: note = Synthetic Construct
  source 1..29: mol_type = other DNA
cctacagcctaagaaagatctagaaccaa

SEQ ID NO: 43552 - DNA, 21 bp, synthetic construct
  misc_feature 1..21: note = Synthetic Construct
  source 1..21: mol_type = other DNA
gttgggaaccagccctattgt

SEQ ID NO: 43553 - DNA, 27 bp, synthetic construct
  misc_feature 1..27: note = Synthetic Construct
  source 1..27: mol_type = other DNA
gggcatatgataacatttggggagatg

SEQ ID NO: 43554 - DNA, 22 bp, synthetic construct
  misc_feature 1..22: note = Synthetic Construct
  source 1..22: mol_type = other DNA
cgaacgctacacaggcatcctt

SEQ ID NO: 43555 - DNA, 26 bp, synthetic construct
  misc_feature 1..26: note = Synthetic Construct
  source 1..26: mol_type = other DNA
gtaactacgcaatatgccttcacatc

SEQ ID NO: 43556 - DNA, 22 bp, synthetic construct
  misc_feature 1..22: note = Synthetic Construct
  source 1..22: mol_type = other DNA
cgtgacaaggctgaaggtggta

SEQ ID NO: 43557 - DNA, 23 bp, synthetic construct
  misc_feature 1..23: note = Synthetic Construct
  source 1..23: mol_type = other DNA
gggacatttcagaacccatgtct

SEQ ID NO: 43558 - DNA, 20 bp, synthetic construct
  misc_feature 1..20: note = Synthetic Construct
  source 1..20: mol_type = other DNA
acacggcctacccaactaca

SEQ ID NO: 43559 - DNA, 25 bp, synthetic construct
  misc_feature 1..25: note = Synthetic Construct
  source 1..25: mol_type = other DNA
ggctcagagagcaatttgggaatgt

SEQ ID NO: 43560 - DNA, 20 bp, synthetic construct
  misc_feature 1..20: note = Synthetic Construct
  source 1..20: mol_type = other DNA
ttgcctagctggcaggtgta

SEQ ID NO: 43561 - DNA, 26 bp, synthetic construct
  misc_feature 1..26: note = Synthetic Construct
  source 1..26: mol_type = other DNA
gcaggaggtgataaaagcaacagtga

SEQ ID NO: 43562 - DNA, 22 bp, synthetic construct
  misc_feature 1..22: note = Synthetic Construct
  source 1..22: mol_type = other DNA
aaaacagcatcaggtcccatgt

SEQ ID NO: 43563 - DNA, 28 bp, synthetic construct
  misc_feature 1..28: note = Synthetic Construct
  source 1..28: mol_type = other DNA
ggtcatttgattactttcgggaggacaa

SEQ ID NO: 43564 - DNA, 20 bp, synthetic construct
  misc_feature 1..20: note = Synthetic Construct
  source 1..20: mol_type = other DNA
aggaggccagacagccagat

SEQ ID NO: 43565 - DNA, 25 bp, synthetic construct
  misc_feature 1..25: note = Synthetic Construct
  source 1..25: mol_type = other DNA
ccctgtgtctttggtcacgtaactt

SEQ ID NO: 43566 - DNA, 22 bp, synthetic construct
  misc_feature 1..22: note = Synthetic Construct
  source 1..22: mol_type = other DNA
gtctggctgtgacaagaactga

SEQ ID NO: 43567 - DNA, 23 bp, synthetic construct
  misc_feature 1..23: note = Synthetic Construct
  source 1..23: mol_type = other DNA
ccgttatttttgaccgcatgctt

SEQ ID NO: 43568 - DNA, 24 bp, synthetic construct
  misc_feature 1..24: note = Synthetic Construct
  source 1..24: mol_type = other DNA
gcctagaacctgttcccacaaagt

SEQ ID NO: 43569 - DNA, 23 bp, synthetic construct
  misc_feature 1..23: note = Synthetic Construct
  source 1..23: mol_type = other DNA
gcccagtgattagcacaaagtga

SEQ ID NO: 43570 - DNA, 20 bp, synthetic construct
  misc_feature 1..20: note = Synthetic Construct
  source 1..20: mol_type = other DNA
tcgggccagcttaccctatg

SEQ ID NO: 43571 - DNA, 19 bp, synthetic construct
  misc_feature 1..19: note = Synthetic Construct
  source 1..19: mol_type = other DNA
tgccccaggctgaccatga

SEQ ID NO: 43572 - DNA, 24 bp, synthetic construct
  misc_feature 1..24: note = Synthetic Construct
  source 1..24: mol_type = other DNA
caaggatgtttttccaggctgcta

SEQ ID NO: 43573 - DNA, 22 bp, synthetic construct
  misc_feature 1..22: note = Synthetic Construct
  source 1..22: mol_type = other DNA
caaacagcaggtgtaggagtca

SEQ ID NO: 43574 - DNA, 25 bp, synthetic construct
  misc_feature 1..25: note = Synthetic Construct
  source 1..25: mol_type = other DNA
ggaggaggagaagtgggtagagatg

SEQ ID NO: 43575 - DNA, 24 bp, synthetic construct
  misc_feature 1..24: note = Synthetic Construct
  source 1..24: mol_type = other DNA
gaagtgtgagaggaacttgactga

SEQ ID NO: 43576 - DNA, 24 bp, synthetic construct
  misc_feature 1..24: note = Synthetic Construct
  source 1..24: mol_type = other DNA
ggacccagtcaaagaactggaaca

SEQ ID NO: 43577 - DNA, 20 bp, synthetic construct
  misc_feature 1..20: note = Synthetic Construct
  source 1..20: mol_type = other DNA
cgctctgggacactggaagt

SEQ ID NO: 43578 - DNA, 21 bp, synthetic construct
  misc_feature 1..21: note = Synthetic Construct
  source 1..21: mol_type = other DNA
tcgccagtcactgctcctttg

SEQ ID NO: 43579 - DNA, 23 bp, synthetic construct
  misc_feature 1..23: note = Synthetic Construct
  source 1..23: mol_type = other DNA
cctttcctcagacaggcttcatc

SEQ ID NO: 43580 - DNA, 24 bp, synthetic construct
  misc_feature 1..24: note = Synthetic Construct
  source 1..24: mol_type = other DNA
gcctcctccagcctcccaatataa

SEQ ID NO: 43581 - DNA, 22 bp, synthetic construct
  misc_feature 1..22: note = Synthetic Construct
  source 1..22: mol_type = other DNA
accctgtgacatgagggagaga

SEQ ID NO: 43582 - DNA, 23 bp, synthetic construct
  misc_feature 1..23: note = Synthetic Construct
  source 1..23: mol_type = other DNA
gagctgattgcaggagacactac

SEQ ID NO: 43583 - DNA, 20 bp, synthetic construct
  misc_feature 1..20: note = Synthetic Construct
  source 1..20: mol_type = other DNA
ggccaaaggccctgtgctat

SEQ ID NO: 43584 - DNA, 24 bp, synthetic construct
  misc_feature 1..24: note = Synthetic Construct
  source 1..24: mol_type = other DNA
ccggctggtcttattaaccctaag

SEQ ID NO: 43585 - DNA, 26 bp, synthetic construct
  misc_feature 1..26: note = Synthetic Construct
  source 1..26: mol_type = other DNA
ccccatagtataacttctcgcagctt

SEQ ID NO: 43586 - DNA, 27 bp, synthetic construct
  misc_feature 1..27: note = Synthetic Construct
  source 1..27: mol_type = other DNA
ctggcattagatgagttgacagcctta

SEQ ID NO: 43587 - DNA, 22 bp, synthetic construct
  misc_feature 1..22: note = Synthetic Construct
  source 1..22: mol_type = other DNA
gggtgctttcccttgagtgagt

SEQ ID NO: 43588 - DNA, 26 bp, synthetic construct
  misc_feature 1..26: note = Synthetic Construct
  source 1..26: mol_type = other DNA
gcatgattgttccttagaagctgtag

SEQ ID NO: 43589 - DNA, 21 bp, synthetic construct
  misc_feature 1..21: note = Synthetic Construct
  source 1..21: mol_type = other DNA
cccattggagaggctcacctt

SEQ ID NO: 43590 - DNA, 22 bp, synthetic construct
  misc_feature 1..22: note = Synthetic Construct
  source 1..22: mol_type = other DNA
ccccgaccttgaactcaccaaa

SEQ ID NO: 43591 - DNA, 23 bp, synthetic construct
  misc_feature 1..23: note = Synthetic Construct
  source 1..23: mol_type = other DNA
cctgggctggtccaacaactaag

SEQ ID NO: 43592 - DNA, 26 bp, synthetic construct
  misc_feature 1..26: note = Synthetic Construct
  source 1..26: mol_type = other DNA
ggctctaacataacacacgcgtcact

SEQ ID NO: 43593 - DNA, 19 bp, synthetic construct
  misc_feature 1..19: note = Synthetic Construct
  source 1..19: mol_type = other DNA
agcggagcccagtgagtta

SEQ ID NO: 43594 - DNA, 22 bp, synthetic construct
  misc_feature 1..22: note = Synthetic Construct
  source 1..22: mol_type = other DNA
gtctgaccccactggattgtga

SEQ ID NO: 43595 - DNA, 26 bp, synthetic construct
  misc_feature 1..26: note = Synthetic Construct
  source 1..26: mol_type = other DNA
gacattcagttcacaatctggagtca

SEQ ID NO: 43596 - DNA, 24 bp, synthetic construct
  misc_feature 1..24: note = Synthetic Construct
  source 1..24: mol_type = other DNA
gaaaacactggacaaggagtcagt

SEQ ID NO: 43597 - DNA, 19 bp, synthetic construct
  misc_feature 1..19: note = Synthetic Construct
  source 1..19: mol_type = other DNA
gccatcacgccaccagaca

SEQ ID NO: 43598 - DNA, 22 bp, synthetic construct
  misc_feature 1..22: note = Synthetic Construct
  source 1..22: mol_type = other DNA
ccacagaccccagtttctgctt

SEQ ID NO: 43599 - DNA, 24 bp, synthetic construct
  misc_feature 1..24: note = Synthetic Construct
  source 1..24: mol_type = other DNA
gcccagatctcccttccttgatct

SEQ ID NO: 43600 - DNA, 20 bp, synthetic construct
  misc_feature 1..20: note = Synthetic Construct
  source 1..20: mol_type = other DNA
gcaaaaggctggggttgaga

SEQ ID NO: 43601 - DNA, 21 bp, synthetic construct
  misc_feature 1..21: note = Synthetic Construct
  source 1..21: mol_type = other DNA
gtctcctggtgttacctgcaa

SEQ ID NO: 43602 - DNA, 23 bp, synthetic construct
  misc_feature 1..23: note = Synthetic Construct
  source 1..23: mol_type = other DNA
gtggagtcagcaggagatgtgaa

SEQ ID NO: 43603 - DNA, 20 bp, synthetic construct
  misc_feature 1..20: note = Synthetic Construct
  source 1..20: mol_type = other DNA
agtgcccactttcccactgt

SEQ ID NO: 43604 - DNA, 22 bp, synthetic construct
  misc_feature 1..22: note = Synthetic Construct
  source 1..22: mol_type = other DNA
ggctctgtgctaaagggtggaa

SEQ ID NO: 43605 - DNA, 21 bp, synthetic construct
  misc_feature 1..21: note = Synthetic Construct
  source 1..21: mol_type = other DNA
catgctgtgagcctgatgtga

SEQ ID NO: 43606 - DNA, 21 bp, synthetic construct
  misc_feature 1..21: note = Synthetic Construct
  source 1..21: mol_type = other DNA
cacaggagcatatgcgggaaa

SEQ ID NO: 43607 - DNA, 22 bp, synthetic construct
  misc_feature 1..22: note = Synthetic Construct
  source 1..22: mol_type = other DNA
actctatgccctccacacagat

SEQ ID NO: 43608 - DNA, 22 bp, synthetic construct
  misc_feature 1..22: note = Synthetic Construct
  source 1..22: mol_type = other DNA
agctcctggtgtgtctgaggat

SEQ ID NO: 43609 - DNA, 24 bp, synthetic construct
  misc_feature 1..24: note = Synthetic Construct
  source 1..24: mol_type = other DNA
gctttcaacagtcagcgtctctct

SEQ ID NO: 43610 - DNA, 26 bp, synthetic construct
  misc_feature 1..26: note = Synthetic Construct
  source 1..26: mol_type = other DNA
ggtaccatcttagcctctccatgtct

SEQ ID NO: 43611 - DNA, 23 bp, synthetic construct
  misc_feature 1..23: note = Synthetic Construct
  source 1..23: mol_type = other DNA
cgatatctcactccaccatgcaa

SEQ ID NO: 43612 - DNA, 22 bp, synthetic construct
  misc_feature 1..22: note = Synthetic Construct
  source 1..22: mol_type = other DNA
cttgccgggtctgtctgtattg

SEQ ID NO: 43613 - DNA, 22 bp, synthetic construct
  misc_feature 1..22: note = Synthetic Construct
  source 1..22: mol_type = other DNA
ggtcactgctttgcccaagact

SEQ ID NO: 43614 - DNA, 23 bp, synthetic construct
  misc_feature 1..23: note = Synthetic Construct
  source 1..23: mol_type = other DNA
gcattctgagcttcaggggaagt

SEQ ID NO: 43615 - DNA, 22 bp, synthetic construct
  misc_feature 1..22: note = Synthetic Construct
  source 1..22: mol_type = other DNA
ggtgaatagctgggtgctctga

SEQ ID NO: 43616 - DNA, 23 bp, synthetic construct
  misc_feature 1..23: note = Synthetic Construct
  source 1..23: mol_type = other DNA
actgaatgaataagcccgctgaa

SEQ ID NO: 43617 - DNA, 24 bp, synthetic construct
  misc_feature 1..24: note = Synthetic Construct
  source 1..24: mol_type = other DNA
gccagaggaagagatcctgccaaa

SEQ ID NO: 43618 - DNA, 24 bp, synthetic construct
  misc_feature 1..24: note = Synthetic Construct
  source 1..24: mol_type = other DNA
ggcttgaattcctgcctagacctt

SEQ ID NO: 43619 - DNA, 27 bp, synthetic construct
  misc_feature 1..27: note = Synthetic Construct
  source 1..27: mol_type = other DNA
gctaggtaggctacaggatgcagtaaa

SEQ ID NO: 43620 - DNA, 21 bp, synthetic construct
  misc_feature 1..21: note = Synthetic Construct
  source 1..21: mol_type = other DNA
ggtgagcagcgagcttttaca

SEQ ID NO: 43621 - DNA, 23 bp, synthetic construct
  misc_feature 1..23: note = Synthetic Construct
  source 1..23: mol_type = other DNA
cgcgtgagctgtttttaatgttg

SEQ ID NO: 43622 - DNA, 20 bp, synthetic construct
  misc_feature 1..20: note = Synthetic Construct
  source 1..20: mol_type = other DNA
agggtcagatgcgtggtttg

SEQ ID NO: 43623 - DNA, 25 bp, synthetic construct
  misc_feature 1..25: note = Synthetic Construct
  source 1..25: mol_type = other DNA
ggaaatagcctcttccatgggactt

SEQ ID NO: 43624 - DNA, 21 bp, synthetic construct
  misc_feature 1..21: note = Synthetic Construct
  source 1..21: mol_type = other DNA
tggggtcagagccaagcagat

SEQ ID NO: 43625 - DNA, 22 bp, synthetic construct
  misc_feature 1..22: note = Synthetic Construct
  source 1..22: mol_type = other DNA
tgtcagtcagggccaatcatac

SEQ ID NO: 43626 - DNA, 24 bp, synthetic construct
  misc_feature 1..24: note = Synthetic Construct
  source 1..24: mol_type = other DNA
ggcaaggagtctcaatccctgcaa

SEQ ID NO: 43627 - DNA, 22 bp, synthetic construct
  misc_feature 1..22: note = Synthetic Construct
  source 1..22: mol_type = other DNA
gcagggtctgatctccctcctt

SEQ ID NO: 43628 - DNA, 22 bp, synthetic construct
  misc_feature 1..22: note = Synthetic Construct
  source 1..22: mol_type = other DNA
gagccttgtcaatgcggtaatg

SEQ ID NO: 43629 - DNA, 25 bp, synthetic construct
  misc_feature 1..25: note = Synthetic Construct
  source 1..25: mol_type = other DNA
cacgcagtcagctaacacagtatct

SEQ ID NO: 43630 - DNA, 20 bp, synthetic construct
  misc_feature 1..20: note = Synthetic Construct
  source 1..20: mol_type = other DNA
agggcagggacgacaaagtt

SEQ ID NO: 43631 - DNA, 22 bp, synthetic construct
  misc_feature 1..22: note = Synthetic Construct
  source 1..22: mol_type = other DNA
ccaagacatggggctcttcctt

SEQ ID NO: 43632 - DNA, 19 bp, synthetic construct
  misc_feature 1..19: note = Synthetic Construct
  source 1..19: mol_type = other DNA
aagctggctgcctgcaagt

SEQ ID NO: 43633 - DNA, 22 bp, synthetic construct
  misc_feature 1..22: note = Synthetic Construct
  source 1..22: mol_type = other DNA
ctcagagctctccttccccttt

SEQ ID NO: 43634 - DNA, 18 bp, synthetic construct
  misc_feature 1..18: note = Synthetic Construct
  source 1..18: mol_type = other DNA
ccccaatgcaggcgatga

SEQ ID NO: 43635 - DNA, 24 bp, synthetic construct
  misc_feature 1..24: note = Synthetic Construct
  source 1..24: mol_type = other DNA
gcaggaagggtgaagtagcaggtt

SEQ ID NO: 43636 - DNA, 21 bp, synthetic construct
  misc_feature 1..21: note = Synthetic Construct
  source 1..21: mol_type = other DNA
agaccagggtagctggagtga

SEQ ID NO: 43637 - DNA, 25 bp, synthetic construct
  misc_feature 1..25: note = Synthetic Construct
  source 1..25: mol_type = other DNA
cctgagtagttgacagtgcgaggaa

SEQ ID NO: 43638 - DNA, 19 bp, synthetic construct
  misc_feature 1..19: note = Synthetic Construct
  source 1..19: mol_type = other DNA
aagggcccaagacctggta

SEQ ID NO: 43639 - DNA, 22 bp, synthetic construct
  misc_feature 1..22: note = Synthetic Construct
  source 1..22: mol_type = other DNA
cagttgtctggctgggacatga

SEQ ID NO: 43640 - DNA, 19 bp, synthetic construct
  misc_feature 1..19: note = Synthetic Construct
  source 1..19: mol_type = other DNA
aggcaatccgctgttggtt

SEQ ID NO: 43641 - DNA, 20 bp, synthetic construct
  misc_feature 1..20: note = Synthetic Construct
  source 1..20: mol_type = other DNA
agcacaaaagcagccacaga

SEQ ID NO: 43642 - DNA, 22 bp, synthetic construct
  misc_feature 1..22: note = Synthetic Construct
  source 1..22: mol_type = other DNA
cctcagcacttacacggtgaca

SEQ ID NO: 43643 - DNA, 25 bp, synthetic construct
  misc_feature 1..25: note = Synthetic Construct
  source 1..25: mol_type = other DNA
gggaggattacccacctaggttttg

SEQ ID NO: 43644 - DNA, 24 bp, synthetic construct
  misc_feature 1..24: note = Synthetic Construct
  source 1..24: mol_type = other DNA
cagagtctgagcagtgtcttggaa

SEQ ID NO: 43645 - DNA, 20 bp, synthetic construct
  misc_feature 1..20: note = Synthetic Construct
  source 1..20: mol_type = other DNA
ttctgctggggctggtgtta

SEQ ID NO: 43646 - DNA, 19 bp, synthetic construct
  misc_feature 1..19: note = Synthetic Construct
  source 1..19: mol_type = other DNA
acactcgcgtgccactgat

SEQ ID NO: 43647 - DNA, 21 bp, synthetic construct
  misc_feature 1..21: note = Synthetic Construct
  source 1..21: mol_type = other DNA
gcaagtctccaccagcctctt

SEQ ID NO: 43648 - DNA, 25 bp, synthetic construct
  misc_feature 1..25: note = Synthetic Construct
  source 1..25: mol_type = other DNA
cccactcctaaatgtgtagggacta

SEQ ID NO: 43649 - DNA, 25 bp, synthetic construct
  misc_feature 1..25: note = Synthetic Construct
  source 1..25: mol_type = other DNA
gagtagttcctccctactccagaga

SEQ ID NO: 43650 - DNA, 18 bp, synthetic construct
  misc_feature 1..18: note = Synthetic Construct
  source 1..18: mol_type = other DNA
ttcctggccaccctcagt

SEQ ID NO: 43651 - DNA, 25 bp, synthetic construct
  misc_feature 1..25: note = Synthetic Construct
  source 1..25: mol_type = other DNA
gcctgagggatcagtggaaacattg

SEQ ID NO: 43652 - DNA, 22 bp, synthetic construct
  misc_feature 1..22: note = Synthetic Construct
  source 1..22: mol_type = other DNA
cgtgctcaaggcagagggttta

SEQ ID NO: 43653 - DNA, 23 bp, synthetic construct
  misc_feature 1..23: note = Synthetic Construct
  source 1..23: mol_type = other DNA
gttttggagggagtgtgatgctt

SEQ ID NO: 43654 - DNA, 24 bp, synthetic construct
  misc_feature 1..24: note = Synthetic Construct
  source 1..24: mol_type = other DNA
gagtcttagtctggtgtgcactga

SEQ ID NO: 43655 - DNA, 27 bp, synthetic construct
  misc_feature 1..27: note = Synthetic Construct
  source 1..27: mol_type = other DNA
gccagtaaacagaagttgtcctgcaaa

SEQ ID NO: 43656 - DNA, 24 bp, synthetic construct
  misc_feature 1..24: note = Synthetic Construct
  source 1..24: mol_type = other DNA
tgaattcgaaccatctacctgcaa

SEQ ID NO: 43657 - DNA, 26 bp, synthetic construct
  misc_feature 1..26: note = Synthetic Construct
  source 1..26: mol_type = other DNA
gtgggttaaaagaggatggtggatga

SEQ ID NO: 43658 - DNA, 24 bp, synthetic construct
  misc_feature 1..24: note = Synthetic Construct
  source 1..24: mol_type = other DNA
gcaggctgccatatttgctgtttc

SEQ ID NO: 43659 - DNA, 25 bp, synthetic construct
  misc_feature 1..25: note = Synthetic Construct
  source 1..25: mol_type = other DNA
cattaaagagcacggtttcatcact

SEQ ID NO: 43660 - DNA, 24 bp, synthetic construct
  misc_feature 1..24: note = Synthetic Construct
  source 1..24: mol_type = other DNA
ggcctcttaagttctaggctgcat

SEQ ID NO: 43661 - DNA, 21 bp, synthetic construct
  misc_feature 1..21: note = Synthetic Construct
  source 1..21: mol_type = other DNA
aagggccttagccatcaccta

SEQ ID NO: 43662 - DNA, 24 bp, synthetic construct
  misc_feature 1..24: note = Synthetic Construct
  source 1..24: mol_type = other DNA
ggacgtgacctcagtcaagctcaa

SEQ ID NO: 43663 - DNA, 20 bp, synthetic construct
  misc_feature 1..20: note = Synthetic Construct
  source 1..20: mol_type = other DNA
agcttgctagcctgccttca

SEQ ID NO: 43664 - DNA, 20 bp, synthetic construct
  misc_feature 1..20: note = Synthetic Construct
  source 1..20: mol_type = other DNA
aatcccagcgtgtgctcatc

SEQ ID NO: 43665 - DNA, 24 bp, synthetic construct
  misc_feature 1..24: note = Synthetic Construct
  source 1..24: mol_type = other DNA
tcacaagacccaaactgcctattc

SEQ ID NO: 43666 - DNA, 20 bp, synthetic construct
  misc_feature 1..20: note = Synthetic Construct
  source 1..20: mol_type = other DNA
taggggccacaggctcttga

SEQ ID NO: 43667 - DNA, 22 bp, synthetic construct
  misc_feature 1..22: note = Synthetic Construct
  source 1..22: mol_type = other DNA
ccgggagaacgtggcagaattt

SEQ ID NO: 43668 - DNA, 20 bp, synthetic construct
  misc_feature 1..20: note = Synthetic Construct
  source 1..20: mol_type = other DNA
gtttggactgagccctgtga

SEQ ID NO: 43669 - DNA, 21 bp, synthetic construct
  misc_feature 1..21: note = Synthetic Construct
  source 1..21: mol_type = other DNA
aagagccaccagcctctggaa

SEQ ID NO: 43670 - DNA, 22 bp, synthetic construct
  misc_feature 1..22: note = Synthetic Construct
  source 1..22: mol_type = other DNA
gtctctgcagccataccaccaa

SEQ ID NO: 43671 - DNA, 21 bp, synthetic construct
  misc_feature 1..21: note = Synthetic Construct
  source 1..21: mol_type = other DNA
gtgttttcagggcagcgtgtt

SEQ ID NO: 43672 - DNA, 21 bp, synthetic construct
  misc_feature 1..21: note = Synthetic Construct
  source 1..21: mol_type = other DNA
cgctggttcccagtgaccttt

SEQ ID NO: 43673 - DNA, 21 bp, synthetic construct
  misc_feature 1..21: note = Synthetic Construct
  source 1..21: mol_type = other DNA
acacaccccatctctgctgaa

SEQ ID NO: 43674 - DNA, 25 bp, synthetic construct
  misc_feature 1..25: note = Synthetic Construct
  source 1..25: mol_type = other DNA
ggctttgagctaactgttcccagat

SEQ ID NO: 43675 - DNA, 25 bp, synthetic construct
  misc_feature 1..25: note = Synthetic Construct
  source 1..25: mol_type = other DNA
cacacactccttgctaatggggatt

SEQ ID NO: 43676 - DNA, 18 bp, synthetic construct
  misc_feature 1..18: note = Synthetic Construct
  source 1..18: mol_type = other DNA
tgcagggctgggaacaca

SEQ ID NO: 43677 - DNA, 23 bp, synthetic construct
  misc_feature 1..23: note = Synthetic Construct
  source 1..23: mol_type = other DNA
cctagagaccatgaccctgttgt

SEQ ID NO: 43678 - DNA, 23 bp, synthetic construct
  misc_feature 1..23: note = Synthetic Construct
  source 1..23: mol_type = other DNA
cgtgcatccgtaaaacaccaatg

SEQ ID NO: 43679 - DNA, 20 bp, synthetic construct
  misc_feature 1..20: note = Synthetic Construct
  source 1..20: mol_type = other DNA
caggtgggctgcatgaaaca

SEQ ID NO: 43680 - DNA, 26 bp, synthetic construct
  misc_feature 1..26: note = Synthetic Construct
  source 1..26: mol_type = other DNA
cctggggtctattctcaacccagtag

SEQ ID NO: 43681 - DNA, 21 bp, synthetic construct
  misc_feature 1..21: note = Synthetic Construct
  source 1..21: mol_type = other DNA
tgaacccctgggcatcttaca

SEQ ID NO: 43682 - DNA, 22 bp, synthetic construct
  misc_feature 1..22: note = Synthetic Construct
  source 1..22: mol_type = other DNA
gttgacctcagccttcatgctt

SEQ ID NO: 43683 - DNA, 21 bp, synthetic construct
  misc_feature 1..21: note = Synthetic Construct
  source 1..21: mol_type = other DNA
ggcagctcatggatggaaagt

SEQ ID NO: 43684 - DNA, 22 bp, synthetic construct
  misc_feature 1..22: note = Synthetic Construct
  source 1..22: mol_type = other DNA
gactccaggggcttgttactca

SEQ ID NO: 43685 - DNA, 24 bp, synthetic construct
  misc_feature 1..24: note = Synthetic Construct
  source 1..24: mol_type = other DNA
gcttcctaaaatgtctgggctctt

SEQ ID NO: 43686 - DNA, 22 bp, synthetic construct
  misc_feature 1..22: note = Synthetic Construct
  source 1..22: mol_type = other DNA
gggtgcgacacaccacataaca

SEQ ID NO: 43687 - DNA, 23 bp, synthetic construct
  misc_feature 1..23: note = Synthetic Construct
  source 1..23: mol_type = other DNA
gctgggaacactgtgcaacatac

SEQ ID NO: 43688 - DNA, 19 bp, synthetic construct
  misc_feature 1..19: note = Synthetic Construct
  source 1..19: mol_type = other DNA
ggatgggacgcctgactct

SEQ ID NO: 43689 - DNA, 21 bp, synthetic construct
  misc_feature 1..21: note = Synthetic Construct
  source 1..21: mol_type = other DNA
tctcgtgcagttcgcctctac

SEQ ID NO: 43690 - DNA, 21 bp, synthetic construct
  misc_feature 1..21: note = Synthetic Construct
  source 1..21: mol_type = other DNA
gcagatgtctgggcttgtttc

SEQ ID NO: 43691 - DNA, 24 bp, synthetic construct
  misc_feature 1..24: note = Synthetic Construct
  source 1..24: mol_type = other DNA
cagagtgttcagaacccagttagt

SEQ ID NO: 43692 - DNA, 19 bp, synthetic construct
  misc_feature 1..19: note = Synthetic Construct
  source 1..19: mol_type = other DNA
atgtcagccacccgtccaa

SEQ ID NO: 43693 - DNA, 23 bp, synthetic construct
  misc_feature 1..23: note = Synthetic Construct
  source 1..23: mol_type = other DNA
cacctacaaatggcctcgtcaca

SEQ ID NO: 43694 - DNA, 20 bp, synthetic construct
  misc_feature 1..20: note = Synthetic Construct
  source 1..20: mol_type = other DNA
tcccttgcaacgtgctcaca

SEQ ID NO: 43695 - DNA, 18 bp, synthetic construct
  misc_feature 1..18: note = Synthetic Construct
  source 1..18: mol_type = other DNA
acacacggccagctccat

SEQ ID NO: 43696 - DNA, 26 bp, synthetic construct
  misc_feature 1..26: note = Synthetic Construct
  source 1..26: mol_type = other DNA
ggaaccaactgatggactcaaagaca

SEQ ID NO: 43697 - DNA, 25 bp, synthetic construct
  misc_feature 1..25: note = Synthetic Construct
  source 1..25: mol_type = other DNA
gcctcctattgagagtcaaggtcta

SEQ ID NO: 43698 - DNA, 21 bp, synthetic construct
  misc_feature 1..21: note = Synthetic Construct
  source 1..21: mol_type = other DNA
cggtccttcaggagggctttg

SEQ ID NO: 43699 - DNA, 23 bp, synthetic construct
  misc_feature 1..23: note = Synthetic Construct
  source 1..23: mol_type = other DNA
cctgcccacatgcctttactttc

SEQ ID NO: 43700 - DNA, 23 bp, synthetic construct
  misc_feature 1..23: note = Synthetic Construct
  source 1..23: mol_type = other DNA
cccgcttcatagaccaggaaatg

SEQ ID NO: 43701 - DNA, 21 bp, synthetic construct
  misc_feature 1..21: note = Synthetic Construct
  source 1..21: mol_type = other DNA
gccaacgaaccgaacctaaac

SEQ ID NO: 43702 - DNA, 21 bp, synthetic construct
  misc_feature 1..21: note = Synthetic Construct
  source 1..21: mol_type = other DNA
ccttcccaaccaagagcaaga

SEQ ID NO: 43703 - DNA, 24 bp, synthetic construct
  misc_feature 1..24: note = Synthetic Construct
  source 1..24: mol_type = other DNA
ggctgtgcctagagataggagcat

SEQ ID NO: 43704 - DNA, 25 bp, synthetic construct
  misc_feature 1..25: note = Synthetic Construct
  source 1..25: mol_type = other DNA
gcaggattaactgtcccctggcata

SEQ ID NO: 43705 - DNA, 21 bp, synthetic construct
  misc_feature 1..21: note = Synthetic Construct
  source 1..21: mol_type = other DNA
gtgtctgtcccttcaccacat

SEQ ID NO: 43706 - DNA, 24 bp, synthetic construct
  misc_feature 1..24: note = Synthetic Construct
  source 1..24: mol_type = other DNA
ggccactacactgtgggttaggat

SEQ ID NO: 43707 - DNA, 22 bp, synthetic construct
  misc_feature 1..22: note = Synthetic Construct
  source 1..22: mol_type = other DNA
gggcagagaatcacgactcctt

SEQ ID NO: 43708 - DNA, 23 bp, synthetic construct
  misc_feature 1..23: note = Synthetic Construct
  source 1..23: mol_type = other DNA
ctcctgaagcgcaaattgtcagt

SEQ ID NO: 43709 - DNA, 20 bp, synthetic construct
  misc_feature 1..20: note = Synthetic Construct
  source 1..20: mol_type = other DNA
acggctgccaacctaaggaa

SEQ ID NO: 43710 - DNA, 20 bp, synthetic construct
  misc_feature 1..20: note = Synthetic Construct
  source 1..20: mol_type = other DNA
tttggggttcctgcctcact

SEQ ID NO: 43711 - DNA, 20 bp, synthetic construct
  misc_feature 1..20: note = Synthetic Construct
  source 1..20: mol_type = other DNA
cggttgcccaatctctcctt

SEQ ID NO: 43712 - DNA, 21 bp, synthetic construct
  misc_feature 1..21: note = Synthetic Construct
  source 1..21: mol_type = other DNA
actccgatgctgggagaccat

SEQ ID NO: 43713 - DNA, 23 bp, synthetic construct
  misc_feature 1..23: note = Synthetic Construct
  source 1..23: mol_type = other DNA
ctttgggaaccccaagtcttttc

SEQ ID NO: 43714 - DNA, 19 bp, synthetic construct
  misc_feature 1..19: note = Synthetic Construct
  source 1..19: mol_type = other DNA
tggagagtggctcccttgt

SEQ ID NO: 43715 - DNA, 21 bp, synthetic construct
  misc_feature 1..21: note = Synthetic Construct
  source 1..21: mol_type = other DNA
gggtcgcttgtgataggacat

SEQ ID NO: 43716 - DNA, 21 bp, synthetic construct
  misc_feature 1..21: note = Synthetic Construct
  source 1..21: mol_type = other DNA
acctcttccacttggctctca

SEQ ID NO: 43717 - DNA, 22 bp, synthetic construct
  misc_feature 1..22: note = Synthetic Construct
  source 1..22: mol_type = other DNA
gcacgtttccacactccccatt

SEQ ID NO: 43718 - DNA, 20 bp, synthetic construct
  misc_feature 1..20: note = Synthetic Construct
  source 1..20: mol_type = other DNA
ccagcagcagaccacttcaa

SEQ ID NO: 43719 - DNA, 20 bp, synthetic construct
  misc_feature 1..20: note = Synthetic Construct
  source 1..20: mol_type = other DNA
ggaatggcgttggtgactgt

SEQ ID NO: 43720 - DNA, 20 bp, synthetic construct
  misc_feature 1..20: note = Synthetic Construct
  source 1..20: mol_type = other DNA
ccacgctgtgtaagccttga

SEQ ID NO: 43721 - DNA, 24 bp, synthetic construct
  misc_feature 1..24: note = Synthetic Construct
  source 1..24: mol_type = other DNA
gaaagccaccaagaaaccgttatg

SEQ ID NO: 43722 - DNA, 19 bp, synthetic construct
  misc_feature 1..19: note = Synthetic Construct
  source 1..19: mol_type = other DNA
agcccgttggtcccacatt

SEQ ID NO: 43723 - DNA, 25 bp, synthetic construct
  misc_feature 1..25: note = Synthetic Construct
  source 1..25: mol_type = other DNA
cctctttctgtagtgagagcagaga

SEQ ID NO: 43724 - DNA, 22 bp, synthetic construct
  misc_feature 1..22: note = Synthetic Construct
  source 1..22: mol_type = other DNA
ctgtggcactggaaggcatatc

SEQ ID NO: 43725 - DNA, 20 bp, synthetic construct
  misc_feature 1..20: note = Synthetic Construct
  source 1..20: mol_type = other DNA
tccacgggatgacgcagatg

SEQ ID NO: 43726 - DNA, 23 bp, synthetic construct
  misc_feature 1..23: note = Synthetic Construct
  source 1..23: mol_type = other DNA
accggtctgtccttcctccaatc

SEQ ID NO: 43727 - DNA, 22 bp, synthetic construct
  misc_feature 1..22: note = Synthetic Construct
  source 1..22: mol_type = other DNA
ggatctcaccatccaggaggaa

SEQ ID NO: 43728 - DNA, 22 bp, synthetic construct
  misc_feature 1..22: note = Synthetic Construct
  source 1..22: mol_type = other DNA
cccatcagcactggggtttgta

SEQ ID NO: 43729 - DNA, 22 bp, synthetic construct
  misc_feature 1..22: note = Synthetic Construct
  source 1..22: mol_type = other DNA
actcttcccttgctccacctaa

SEQ ID NO: 43730 - DNA, 27 bp, synthetic construct
  misc_feature 1..27: note = Synthetic Construct
  source 1..27: mol_type = other DNA
ggctttctgttgtggtcttatggaaac

SEQ ID NO: 43731 - DNA, 21 bp, synthetic construct
  misc_feature 1..21: note = Synthetic Construct
  source 1..21: mol_type = other DNA
aggaccgggcacctcatttgt

SEQ ID NO: 43732 - DNA, 21 bp, synthetic construct
  misc_feature 1..21: note = Synthetic Construct
  source 1..21: mol_type = other DNA
actgtctgaggaaggccagat

SEQ ID NO: 43733 - DNA, 24 bp, synthetic construct
  misc_feature 1..24: note = Synthetic Construct
  source 1..24: mol_type = other DNA
ggcttcctcggaaaaagacagttg

SEQ ID NO: 43734 - DNA, 20 bp, synthetic construct
  misc_feature 1..20: note = Synthetic Construct
  source 1..20: mol_type = other DNA
atcttgccttctgccagcat

SEQ ID NO: 43735 - DNA, 20 bp, synthetic construct
  misc_feature 1..20: note = Synthetic Construct
  source 1..20: mol_type = other DNA
tgtcccagcaaagggtgcta

SEQ ID NO: 43736 - DNA, 23 bp, synthetic construct
  misc_feature 1..23: note = Synthetic Construct
  source 1..23: mol_type = other DNA
tcatccacctatccacctccaat

SEQ ID NO: 43737 - DNA, 24 bp, synthetic construct
  misc_feature 1..24: note = Synthetic Construct
  source 1..24: mol_type = other DNA
gggttcatgctacaggtggccttt

SEQ ID NO: 43738 - DNA, 20 bp, synthetic construct
  misc_feature 1..20: note = Synthetic Construct
  source 1..20: mol_type = other DNA
agcccagccctcccctctta

SEQ ID NO: 43739 - DNA, 22 bp, synthetic construct
  misc_feature 1..22: note = Synthetic Construct
  source 1..22: mol_type = other DNA
ccctcatggctccattccaagt

SEQ ID NO: 43740 - DNA, 24 bp, synthetic construct
  misc_feature 1..24: note = Synthetic Construct
  source 1..24: mol_type = other DNA
tgtttgcaattctgtgaccctaca

SEQ ID NO: 43741 - DNA, 22 bp, synthetic construct
  misc_feature 1..22: note = Synthetic Construct
  source 1..22: mol_type = other DNA
ggaggacattaccagggcagaa

SEQ ID NO: 43742 - DNA, 22 bp, synthetic construct
  misc_feature 1..22: note = Synthetic Construct
  source 1..22: mol_type = other DNA
gcaaacaacacactcagcagat

SEQ ID NO: 43743 - DNA, 20 bp, synthetic construct
  misc_feature 1..20: note = Synthetic Construct
  source 1..20: mol_type = other DNA
tgacgtgagaggggtacaca

SEQ ID NO: 43744 - DNA, 21 bp, synthetic construct
  misc_feature 1..21: note = Synthetic Construct
  source 1..21: mol_type = other DNA
acttcctgtgggccagtgttg

SEQ ID NO: 43745 - DNA, 19 bp, synthetic construct
  misc_feature 1..19: note = Synthetic Construct
  source 1..19: mol_type = other DNA
agacaccacgggcctcctt

SEQ ID NO: 43746 - DNA, 19 bp, synthetic construct
  misc_feature 1..19: note = Synthetic Construct
  source 1..19: mol_type = other DNA
agggaacgaggcaggactt

SEQ ID NO: 43747 - DNA, 24 bp, synthetic construct
  misc_feature 1..24: note = Synthetic Construct
  source 1..24: mol_type = other DNA
ctttggaatctgtgcttcctggat

SEQ ID NO: 43748 - DNA, 21 bp, synthetic construct
  misc_feature 1..21: note = Synthetic Construct
  source 1..21: mol_type = other DNA
acactgcaagtccagcctact

SEQ ID NO: 43749 - DNA, 24 bp, synthetic construct
  misc_feature 1..24: note = Synthetic Construct
  source 1..24: mol_type = other DNA
gatttcgtaccacctttcctctgt

SEQ ID NO: 43750 - DNA, 19 bp, synthetic construct
  misc_feature 1..19: note = Synthetic Construct
  source 1..19: mol_type = other DNA
tgcagctggggtgttctca

SEQ ID NO: 43751 - DNA, 19 bp, synthetic construct
  misc_feature 1..19: note = Synthetic Construct
  source 1..19: mol_type = other DNA
cacctcagcagccatgctt

SEQ ID NO: 43752 - DNA, 20 bp, synthetic construct
  misc_feature 1..20: note = Synthetic Construct
  source 1..20: mol_type = other DNA
tctcagaacctcccgccata

SEQ ID NO: 43753 - DNA, 23 bp, synthetic construct
  misc_feature 1..23: note = Synthetic Construct
  source 1..23: mol_type = other DNA
ggcagagaagcatgcaagggaaa

SEQ ID NO: 43754 - DNA, 22 bp, synthetic construct
  misc_feature 1..22: note = Synthetic Construct
  source 1..22: mol_type = other DNA
ggctgccttccacctatggttt

SEQ ID NO: 43755 - DNA, 24 bp, synthetic construct
  misc_feature 1..24: note = Synthetic Construct
  source 1..24: mol_type = other DNA
cattgggaccaagtgcttatcatc

SEQ ID NO: 43756 - DNA, 24 bp, synthetic construct
  misc_feature 1..24: note = Synthetic Construct
  source 1..24: mol_type = other DNA
ctgttgagatcagagggagtggat

SEQ ID NO: 43757 - DNA, 21 bp, synthetic construct
  misc_feature 1..21: note = Synthetic Construct
  source 1..21: mol_type = other DNA
aggccacccgtaatcgtgtct

SEQ ID NO: 43758 - DNA, 22 bp, synthetic construct
  misc_feature 1..22: note = Synthetic Construct
  source 1..22: mol_type = other DNA
gcacaatggcagaatgcagtta

SEQ ID NO: 43759 - DNA, 20 bp, synthetic construct
  misc_feature 1..20: note = Synthetic Construct
  source 1..20: mol_type = other DNA
agccagatggcggctcttta

SEQ ID NO: 43760 - DNA, 25 bp, synthetic construct
  misc_feature 1..25: note = Synthetic Construct
  source 1..25: mol_type = other DNA
tgtgctgatactcagtttgacttgt

SEQ ID NO: 43761 - DNA, 27 bp, synthetic construct
  misc_feature 1..27: note = Synthetic Construct
  source 1..27: mol_type = other DNA
cctcctaagaggagtcttcagtggttt

SEQ ID NO: 43762 - DNA, 25 bp, synthetic construct
  misc_feature 1..25: note = Synthetic Construct
  source 1..25: mol_type = other DNA
gcaaagagcccttttgagaggtaac

SEQ ID NO: 43763 - DNA, 21 bp, synthetic construct
  misc_feature 1..21: note = Synthetic Construct
  source 1..21: mol_type = other DNA
ggcctgttccaccaaaacttg

SEQ ID NO: 43764 - DNA, 20 bp, synthetic construct
  misc_feature 1..20: note = Synthetic Construct
  source 1..20: mol_type = other DNA
ggcataaaggcggggcttct

SEQ ID NO: 43765 - DNA, 20 bp, synthetic construct
  misc_feature 1..20: note = Synthetic Construct
  source 1..20: mol_type = other DNA
ctgcatggagacgctgatct

SEQ ID NO: 43766 - DNA, 24 bp, synthetic construct
  misc_feature 1..24: note = Synthetic Construct
  source 1..24: mol_type = other DNA
gcagaaatcttgcagtgggataag

SEQ ID NO: 43767 - DNA, 22 bp, synthetic construct
  misc_feature 1..22: note = Synthetic Construct
  source 1..22: mol_type = other DNA
tgagaggagcagtgggatctga

SEQ ID NO: 43768 - DNA, 27 bp, synthetic construct
  misc_feature 1..27: note = Synthetic Construct
  source 1..27: mol_type = other DNA
gcaggaagtctccatctatgaggaaca

SEQ ID NO: 43769 - DNA, 23 bp, synthetic construct
  misc_feature 1..23: note = Synthetic Construct
  source 1..23: mol_type = other DNA
tgaagaggattcagcccagtttc

SEQ ID NO: 43770 - DNA, 29 bp, synthetic construct
  misc_feature 1..29: note = Synthetic Construct
  source 1..29: mol_type = other DNA
ctcagaagttttaccgaggactatagaag

SEQ ID NO: 43771 - DNA, 21 bp, synthetic construct
  misc_feature 1..21: note = Synthetic Construct
  source 1..21: mol_type = other DNA
ggccaagaaggggaatgaaca

SEQ ID NO: 43772 - DNA, 22 bp, synthetic construct
  misc_feature 1..22: note = Synthetic Construct
  source 1..22: mol_type = other DNA
accccacctccattctccttag

SEQ ID NO: 43773 - DNA, 23 bp, synthetic construct
  misc_feature 1..23: note = Synthetic Construct
  source 1..23: mol_type = other DNA
tggtggcttttggttgagttaca

SEQ ID NO: 43774 - DNA, 21 bp, synthetic construct
  misc_feature 1..21: note = Synthetic Construct
  source 1..21: mol_type = other DNA
cggtaggtgaagggactgtgt

SEQ ID NO: 43775 - DNA, 20 bp, synthetic construct
  misc_feature 1..20: note = Synthetic Construct
  source 1..20: mol_type = other DNA
ggtgaggctttctgctccat

SEQ ID NO: 43776 - DNA, 19 bp, synthetic construct
  misc_feature 1..19: note = Synthetic Construct
  source 1..19: mol_type = other DNA
caagcccctctgggagtgt

SEQ ID NO: 43777 - DNA, 19 bp, synthetic construct
  misc_feature 1..19: note = Synthetic Construct
  source 1..19: mol_type = other DNA
atgcgggagaggggagaag

SEQ ID NO: 43778 - DNA, 22 bp, synthetic construct
  misc_feature 1..22: note = Synthetic Construct
  source 1..22: mol_type = other DNA
ctgaactctgccagcccaagat

SEQ ID NO: 43779 - DNA, 18 bp, synthetic construct
  misc_feature 1..18: note = Synthetic Construct
  source 1..18: mol_type = other DNA
tgccaccacgccagcatt

SEQ ID NO: 43780 - DNA, 22 bp, synthetic construct
  misc_feature 1..22: note = Synthetic Construct
  source 1..22: mol_type = other DNA
ctgggagtgggaggaatggaaa

SEQ ID NO: 43781 - DNA, 24 bp, synthetic construct
  misc_feature 1..24: note = Synthetic Construct
  source 1..24: mol_type = other DNA
tgctattgcctttgaaccacattc

SEQ ID NO: 43782 - DNA, 27 bp, synthetic construct
  misc_feature 1..27: note = Synthetic Construct
  source 1..27: mol_type = other DNA
cccctgtagccacttttgagtggaaaa

SEQ ID NO: 43783 - DNA, 24 bp, synthetic construct
  misc_feature 1..24: note = Synthetic Construct
  source 1..24: mol_type = other DNA
ggagttactgctgattgcctgaca

SEQ ID NO: 43784 - DNA, 21 bp, synthetic construct
  misc_feature 1..21: note = Synthetic Construct
  source 1..21: mol_type = other DNA
acactgggaaccagggactga

SEQ ID NO: 43785 - DNA, 20 bp, synthetic construct
  misc_feature 1..20: note = Synthetic Construct
  source 1..20: mol_type = other DNA
tggggcagcatctcaacact

SEQ ID NO: 43786 - DNA, 22 bp, synthetic construct
  misc_feature 1..22: note = Synthetic Construct
  source 1..22: mol_type = other DNA
gcctggttttctgcgtgtggaa

SEQ ID NO: 43787 - DNA, 19 bp, synthetic construct
  misc_feature 1..19: note = Synthetic Construct
  source 1..19: mol_type = other DNA
aagcggctgcaggctggaa

SEQ ID NO: 43788 - DNA, 22 bp, synthetic construct
  misc_feature 1..22: note = Synthetic Construct
  source 1..22: mol_type = other DNA
ctcttcctaccagcacaaccat

SEQ ID NO: 43789 - DNA, 20 bp, synthetic construct
  misc_feature 1..20: note = Synthetic Construct
  source 1..20: mol_type = other DNA
ccacctctgctgcaatggaa

SEQ ID NO: 43790 - DNA, 19 bp, synthetic construct
  misc_feature 1..19: note = Synthetic Construct
  source 1..19: mol_type = other DNA
acagcagaggcgggacaca

SEQ ID NO: 43791 - DNA, 23 bp, synthetic construct
  misc_feature 1..23: note = Synthetic Construct
  source 1..23: mol_type = other DNA
tgatgtaggaaccaagggtcagt

SEQ ID NO: 43792 - DNA, 19 bp, synthetic construct
  misc_feature 1..19: note = Synthetic Construct
  source 1..19: mol_type = other DNA
agcgctctccagccttgaa

SEQ ID NO: 43793 - DNA, 21 bp, synthetic construct
  misc_feature 1..21: note = Synthetic Construct
  source 1..21: mol_type = other DNA
agagggcctgggttctaggta

SEQ ID NO: 43794 - DNA, 21 bp, synthetic construct
  misc_feature 1..21: note = Synthetic Construct
  source 1..21: mol_type = other DNA
aaggccagttagccccagact

SEQ ID NO: 43795 - DNA, 22 bp, synthetic construct
  misc_feature 1..22: note = Synthetic Construct
  source 1..22: mol_type = other DNA
accagttggccatcctagagaa

SEQ ID NO: 43796 - DNA, 23 bp, synthetic construct
  misc_feature 1..23: note = Synthetic Construct
  source 1..23: mol_type = other DNA
ctccatttgcactttggaactgt

SEQ ID NO: 43797 - DNA, 25 bp, synthetic construct
  misc_feature 1..25: note = Synthetic Construct
  source 1..25: mol_type = other DNA
caggcacaatttaacccatcacact

SEQ ID NO: 43798 - DNA, 21 bp, synthetic construct
  misc_feature 1..21: note = Synthetic Construct
  source 1..21: mol_type = other DNA
gctcgccctacactcttgctt

SEQ ID NO: 43799 - DNA, 22 bp, synthetic construct
  misc_feature 1..22: note = Synthetic Construct
  source 1..22: mol_type = other DNA
tcttccaaacacctcgcttcaa

SEQ ID NO: 43800 - DNA, 23 bp, synthetic construct
  misc_feature 1..23: note = Synthetic Construct
  source 1..23: mol_type = other DNA
tgtagtccacaggctgcaaatac

SEQ ID NO: 43801 - DNA, 20 bp, synthetic construct
  misc_feature 1..20: note = Synthetic Construct
  source 1..20: mol_type = other DNA
agactgccagggtggagtga

SEQ ID NO: 43802 - DNA, 23 bp, synthetic construct
  misc_feature 1..23: note = Synthetic Construct
  source 1..23: mol_type = other DNA
tgagtttcttctctgcaggtgtt

SEQ ID NO: 43803 - DNA, 21 bp, synthetic construct
  misc_feature 1..21: note = Synthetic Construct
  source 1..21: mol_type = other DNA
tttgccccagaggctcacaca

SEQ ID NO: 43804 - DNA, 22 bp, synthetic construct
  misc_feature 1..22: note = Synthetic Construct
  source 1..22: mol_type = other DNA
cttgctcatcctccacttgtct

SEQ ID NO: 43805 - DNA, 22 bp, synthetic construct
  misc_feature 1..22: note = Synthetic Construct
  source 1..22: mol_type = other DNA
ctgaaaagtctgcagcccaaaa

SEQ ID NO: 43806 - DNA, 27 bp, synthetic construct
  misc_feature 1..27: note = Synthetic Construct
  source 1..27: mol_type = other DNA
cctcttaatatgacccagcgattgtgt

SEQ ID NO: 43807 - DNA, 26 bp, synthetic construct
  misc_feature 1..26: note = Synthetic Construct
  source 1..26: mol_type = other DNA
ggtttctcctccctagaaggaactgt

SEQ ID NO: 43808 - DNA, 20 bp, synthetic construct
  misc_feature 1..20: note = Synthetic Construct
  source 1..20: mol_type = other DNA
ctccattgccagcagctgaa

SEQ ID NO: 43809 - DNA, 20 bp, synthetic construct
  misc_feature 1..20: note = Synthetic Construct
  source 1..20: mol_type = other DNA
tccttgggacctggggtcat

SEQ ID NO: 43810 - DNA, 24 bp, synthetic construct
  misc_feature 1..24: note = Synthetic Construct
  source 1..24: mol_type = other DNA
tcctccatggttagcttggtttac

SEQ ID NO: 43811 - DNA, 19 bp, synthetic construct
  misc_feature 1..19: note = Synthetic Construct
  source 1..19: mol_type = other DNA
agccatggccacagtctct

SEQ ID NO: 43812 - DNA, 25 bp, synthetic construct
  misc_feature 1..25: note = Synthetic Construct
  source 1..25: mol_type = other DNA
acacaaacaacagtccttctcagat

SEQ ID NO: 43813 - DNA, 19 bp, synthetic construct
  misc_feature 1..19: note = Synthetic Construct
  source 1..19: mol_type = other DNA
cagggttccagccctccat

SEQ ID NO: 43814 - DNA, 23 bp, synthetic construct
  misc_feature 1..23: note = Synthetic Construct
  source 1..23: mol_type = other DNA
ggtccacttccttatagctgctt

SEQ ID NO: 43815 - DNA, 25 bp, synthetic construct
  misc_feature 1..25: note = Synthetic Construct
  source 1..25: mol_type = other DNA
ccaagtgtgcaaaaagaaaggctat

SEQ ID NO: 43816 - DNA, 24 bp, synthetic construct
  misc_feature 1..24: note = Synthetic Construct
  source 1..24: mol_type = other DNA
gcactatgagaaggggagcagtca

SEQ ID NO: 43817 - DNA, 22 bp, synthetic construct
  misc_feature 1..22: note = Synthetic Construct
  source 1..22: mol_type = other DNA
agggaatctagccctggggaaa

SEQ ID NO: 43818 - DNA, 23 bp, synthetic construct
  misc_feature 1..23: note = Synthetic Construct
  source 1..23: mol_type = other DNA
ccggggattaagcaacagcaagt

SEQ ID NO: 43819 - DNA, 27 bp, synthetic construct
  misc_feature 1..27: note = Synthetic Construct
  source 1..27: mol_type = other DNA
ccctgatgaaaacacaactgtcaggat

SEQ ID NO: 43820 - DNA, 19 bp, synthetic construct
  misc_feature 1..19: note = Synthetic Construct
  source 1..19: mol_type = other DNA
taccccgtagcgtgagtgt

SEQ ID NO: 43821 - DNA, 19 bp, synthetic construct
  misc_feature 1..19: note = Synthetic Construct
  source 1..19: mol_type = other DNA
accatgcccagccatgaac

SEQ ID NO: 43822 - DNA, 27 bp, synthetic construct
  misc_feature 1..27: note = Synthetic Construct
  source 1..27: mol_type = other DNA
cctctcttgccacatgatctctgtatg

SEQ ID NO: 43823 - DNA, 27 bp, synthetic construct
  misc_feature 1..27: note = Synthetic Construct
  source 1..27: mol_type = other DNA
gggtatgggataatggtggaaggaaca

SEQ ID NO: 43824 - DNA, 22 bp, synthetic construct
  misc_feature 1..22: note = Synthetic Construct
  source 1..22: mol_type = other DNA
catggtcatgcaaagcatccat

SEQ ID NO: 43825 - DNA, 27 bp, synthetic construct
  misc_feature 1..27: note = Synthetic Construct
  source 1..27: mol_type = other DNA
ctctcctttggttttcgatctgctatg

SEQ ID NO: 43826 - DNA, 23 bp, synthetic construct
  misc_feature 1..23: note = Synthetic Construct
  source 1..23: mol_type = other DNA
cgtattctgtagcacagcactga

SEQ ID NO: 43827 - DNA, 23 bp, synthetic construct
  misc_feature 1..23: note = Synthetic Construct
  source 1..23: mol_type = other DNA
agctggaaacctagaaacaccaa

SEQ ID NO: 43828 - DNA, 18 bp, synthetic construct
  misc_feature 1..18: note = Synthetic Construct
  source 1..18: mol_type = other DNA
tgccacccagcactgtga

SEQ ID NO: 43829 - DNA, 22 bp, synthetic construct
  misc_feature 1..22: note = Synthetic Construct
  source 1..22: mol_type = other DNA
cctgctggagacccttcaatct

SEQ ID NO: 43830 - DNA, 20 bp, synthetic construct
  misc_feature 1..20: note = Synthetic Construct
  source 1..20: mol_type = other DNA
aggctgtgctgggccccata

SEQ ID NO: 43831 - DNA, 24 bp, synthetic construct
  misc_feature 1..24: note = Synthetic Construct
  source 1..24: mol_type = other DNA
cagctggacataccaagaccttct

SEQ ID NO: 43832 - DNA, 26 bp, synthetic construct
  misc_feature 1..26: note = Synthetic Construct
  source 1..26: mol_type = other DNA
gtctggtattacactggaggatcaca

SEQ ID NO: 43833 - DNA, 24 bp, synthetic construct
  misc_feature 1..24: note = Synthetic Construct
  source 1..24: mol_type = other DNA
actagcaagtcggaaaacttggaa

SEQ ID NO: 43834 - DNA, 19 bp, synthetic construct
  misc_feature 1..19: note = Synthetic Construct
  source 1..19: mol_type = other DNA
accctgaactcccggcttt

SEQ ID NO: 43835 - DNA, 20 bp, synthetic construct
  misc_feature 1..20: note = Synthetic Construct
  source 1..20: mol_type = other DNA
tgacattgcacagcgtctca

SEQ ID NO: 43836 - DNA, 18 bp, synthetic construct
  misc_feature 1..18: note = Synthetic Construct
  source 1..18: mol_type = other DNA
aaggctgggccactgtgt

SEQ ID NO: 43837 - DNA, 21 bp, synthetic construct
  misc_feature 1..21: note = Synthetic Construct
  source 1..21: mol_type = other DNA
gtgcatgcatgtggtgaggaa

SEQ ID NO: 43838 - DNA, 22 bp, synthetic construct
  misc_feature 1..22: note = Synthetic Construct
  source 1..22: mol_type = other DNA
cagacgttgggcatcacctaga

SEQ ID NO: 43839 - DNA, 20 bp, synthetic construct
  misc_feature 1..20: note = Synthetic Construct
  source 1..20: mol_type = other DNA
ggttggcacacctgcattga

SEQ ID NO: 43840 - DNA, 20 bp, synthetic construct
  misc_feature 1..20: note = Synthetic Construct
  source 1..20: mol_type = other DNA
gccctccgtggaaaggctta

SEQ ID NO: 43841 - DNA, 24 bp, synthetic construct
  misc_feature 1..24: note = Synthetic Construct
  source 1..24: mol_type = other DNA
gagatcctcaggcaccaaagatgt

SEQ ID NO: 43842 - DNA, 22 bp, synthetic construct
  misc_feature 1..22: note = Synthetic Construct
  source 1..22: mol_type = other DNA
aggtgcctctcgtcctcctaac

SEQ ID NO: 43843 - DNA, 22 bp, synthetic construct
  misc_feature 1..22: note = Synthetic Construct
  source 1..22: mol_type = other DNA
cctgaccttggtgctgagttct

SEQ ID NO: 43844 - DNA, 21 bp, synthetic construct
  misc_feature 1..21: note = Synthetic Construct
  source 1..21: mol_type = other DNA
cccctgctatgtgccatcttc

SEQ ID NO: 43845 - DNA, 20 bp, synthetic construct
  misc_feature 1..20: note = Synthetic Construct
  source 1..20: mol_type = other DNA
cttgtgcaaaggccctgcta

SEQ ID NO: 43846 - DNA, 20 bp, synthetic construct
  misc_feature 1..20: note = Synthetic Construct
  source 1..20: mol_type = other DNA
atgccaccggagtgagaaga

SEQ ID NO: 43847 - DNA, 20 bp, synthetic construct
  misc_feature 1..20: note = Synthetic Construct
  source 1..20: mol_type = other DNA
cccaaacatgggtgggctaa

SEQ ID NO: 43848 - DNA, 20 bp, synthetic construct
  misc_feature 1..20: note = Synthetic Construct
  source 1..20: mol_type = other DNA
acctggcacaccccttcaaa

SEQ ID NO: 43849 - DNA, 24 bp, synthetic construct
  misc_feature 1..24: note = Synthetic Construct
  source 1..24: mol_type = other DNA
agtcgttaaatcttcagggcttct

SEQ ID NO: 43850 - DNA, 25 bp, synthetic construct
  misc_feature 1..25: note = Synthetic Construct
  source 1..25: mol_type = other DNA
ctcttaaccactaccctccactact

SEQ ID NO: 43851 - DNA, 22 bp, synthetic construct
  misc_feature 1..22: note = Synthetic Construct
  source 1..22: mol_type = other DNA
ggcagcagaggaccatttacaa

SEQ ID NO: 43852 - DNA, 25 bp, synthetic construct
  misc_feature 1..25: note = Synthetic Construct
  source 1..25: mol_type = other DNA
gcagtgtgtaaaaagccttcagaac

SEQ ID NO: 43853 - DNA, 19 bp, synthetic construct
  misc_feature 1..19: note = Synthetic Construct
  source 1..19: mol_type = other DNA
cagagggtgggagccagtt

SEQ ID NO: 43854 - DNA, 25 bp, synthetic construct
  misc_feature 1..25: note = Synthetic Construct
  source 1..25: mol_type = other DNA
cagatggccactagaactcttcgta

SEQ ID NO: 43855 - DNA, 21 bp, synthetic construct
  misc_feature 1..21: note = Synthetic Construct
  source 1..21: mol_type = other DNA
ggccctggtgtcattttccaa

SEQ ID NO: 43856 - DNA, 22 bp, synthetic construct
  misc_feature 1..22: note = Synthetic Construct
  source 1..22: mol_type = other DNA
gggaagtaggagtggcagtaac

SEQ ID NO: 43857 - DNA, 24 bp, synthetic construct
  misc_feature 1..24: note = Synthetic Construct
  source 1..24: mol_type = other DNA
ctcattccattgcttgctgtggtt

SEQ ID NO: 43858 - DNA, 21 bp, synthetic construct
  misc_feature 1..21: note = Synthetic Construct
  source 1..21: mol_type = other DNA
tgatgcctcttccaccccttt

SEQ ID NO: 43859 - DNA, 20 bp, synthetic construct
  misc_feature 1..20: note = Synthetic Construct
  source 1..20: mol_type = other DNA
tgggcaggaagtcccagaat

SEQ ID NO: 43860 - DNA, 22 bp, synthetic construct
  misc_feature 1..22: note = Synthetic Construct
  source 1..22: mol_type = other DNA
gcatcctctgggaagggttaca

SEQ ID NO: 43861 - DNA, 19 bp, synthetic construct
  misc_feature 1..19: note = Synthetic Construct
  source 1..19: mol_type = other DNA
tctggcaccctgagagctt

SEQ ID NO: 43862 - DNA, 25 bp, synthetic construct
  misc_feature 1..25: note = Synthetic Construct
  source 1..25: mol_type = other DNA
cctctgcttttctagtttccaccaa

SEQ ID NO: 43863 - DNA, 24 bp, synthetic construct
  misc_feature 1..24: note = Synthetic Construct
  source 1..24: mol_type = other DNA
cctggtcacattaggctgttcact

SEQ ID NO: 43864 - DNA, 22 bp, synthetic construct
  misc_feature 1..22: note = Synthetic Construct
  source 1..22: mol_type = other DNA
gcttggcctgcagtcacttaga

SEQ ID NO: 43865 - DNA, 22 bp, synthetic construct
  misc_feature 1..22: note = Synthetic Construct
  source 1..22: mol_type = other DNA
tccttgtggagcagggctaact

SEQ ID NO: 43866 - DNA, 22 bp, synthetic construct
  misc_feature 1..22: note = Synthetic Construct
  source 1..22: mol_type = other DNA
aggaataggggccgtgctgtta

SEQ ID NO: 43867 - DNA, 23 bp, synthetic construct
  misc_feature 1..23: note = Synthetic Construct
  source 1..23: mol_type = other DNA
cccctggtctgcaatcctgaatc

SEQ ID NO: 43868 - DNA, 20 bp, synthetic construct
  misc_feature 1..20: note = Synthetic Construct
  source 1..20: mol_type = other DNA
tgcagagaggcttgggatga

SEQ ID NO: 43869 - DNA, 21 bp, synthetic construct
  misc_feature 1..21: note = Synthetic Construct
  source 1..21: mol_type = other DNA
gcaaggatggggcactacact

SEQ ID NO: 43870 - DNA, 24 bp, synthetic construct
  misc_feature 1..24: note = Synthetic Construct
  source 1..24: mol_type = other DNA
gcaacatcacagacaaacgtggta

SEQ ID NO: 43871 - DNA, 23 bp, synthetic construct
  misc_feature 1..23: note = Synthetic Construct
  source 1..23: mol_type = other DNA
gcagaaaccaacttctgggctta

SEQ ID NO: 43872 - DNA, 22 bp, synthetic construct
  misc_feature 1..22: note = Synthetic Construct
  source 1..22: mol_type = other DNA
tcctccccataacggtggctat

SEQ ID NO: 43873 - DNA, 22 bp, synthetic construct
  misc_feature 1..22: note = Synthetic Construct
  source 1..22: mol_type = other DNA
cctgtcttgggagctgaaccaa

SEQ ID NO: 43874 - DNA, 22 bp, synthetic construct
  misc_feature 1..22: note = Synthetic Construct
  source 1..22: mol_type = other DNA
ctgtgtggctgggatcaagttc

SEQ ID NO: 43875 - DNA, 21 bp, synthetic construct
  misc_feature 1..21: note = Synthetic Construct
  source 1..21: mol_type = other DNA
gcttggcttgctcttgtttca

SEQ ID NO: 43876 - DNA, 20 bp, synthetic construct
  misc_feature 1..20: note = Synthetic Construct
  source 1..20: mol_type = other DNA
gcttcagatccagccacagt

SEQ ID NO: 43877 - DNA, 26 bp, synthetic construct
  misc_feature 1..26: note = Synthetic Construct
  source 1..26: mol_type = other DNA
cgagggatcataggttcttcattttg

SEQ ID NO: 43878 - DNA, 21 bp, synthetic construct
  misc_feature 1..21: note = Synthetic Construct
  source 1..21: mol_type = other DNA
ggcacctggctgagtccattt

SEQ ID NO: 43879 - DNA, 21 bp, synthetic construct
  misc_feature 1..21: note = Synthetic Construct
  source 1..21: mol_type = other DNA
gagagagaaggggctgtctca

SEQ ID NO: 43880 - DNA, 22 bp, synthetic construct
  misc_feature 1..22: note = Synthetic Construct
  source 1..22: mol_type = other DNA
tccaccaactcacccactggaa

SEQ ID NO: 43881 - DNA, 26 bp, synthetic construct
  misc_feature 1..26: note = Synthetic Construct
  source 1..26: mol_type = other DNA
gtgggaagtaagaatcttgcccaaac

SEQ ID NO: 43882 - DNA, 21 bp, synthetic construct
  misc_feature 1..21: note = Synthetic Construct
  source 1..21: mol_type = other DNA
tttctggccccagtgcctctt

SEQ ID NO: 43883 - DNA, 24 bp, synthetic construct
  misc_feature 1..24: note = Synthetic Construct
  source 1..24: mol_type = other DNA
tccttgggatcaacacatgtgaaa

SEQ ID NO: 43884 - DNA, 22 bp, synthetic construct
  misc_feature 1..22: note = Synthetic Construct
  source 1..22: mol_type = other DNA
accaggactgggttctctcttc

SEQ ID NO: 43885 - DNA, 24 bp, synthetic construct
  misc_feature 1..24: note = Synthetic Construct
  source 1..24: mol_type = other DNA
caagtaccatccctgccttactac

SEQ ID NO: 43886 - DNA, 20 bp, synthetic construct
  misc_feature 1..20: note = Synthetic Construct
  source 1..20: mol_type = other DNA
agcagggacaaaggctcaga

SEQ ID NO: 43887 - DNA, 20 bp, synthetic construct
  misc_feature 1..20: note = Synthetic Construct
  source 1..20: mol_type = other DNA
cctgacacccaggaccacaa

SEQ ID NO: 43888 - DNA, 21 bp, synthetic construct
  misc_feature 1..21: note = Synthetic Construct
  source 1..21: mol_type = other DNA
ggttgatggctgtggggaaca

SEQ ID NO: 43889 - DNA, 23 bp, synthetic construct
  misc_feature 1..23: note = Synthetic Construct
  source 1..23: mol_type = other DNA
taggtagcctggggtctgtctct

SEQ ID NO: 43890 - DNA, 22 bp, synthetic construct
  misc_feature 1..22: note = Synthetic Construct
  source 1..22: mol_type = other DNA
gggattacagcctctccacctt

SEQ ID NO: 43891 - DNA, 23 bp, synthetic construct
  misc_feature 1..23: note = Synthetic Construct
  source 1..23: mol_type = other DNA
cagggcagttagactcctgcaat

SEQ ID NO: 43892 - DNA, 23 bp, synthetic construct
  misc_feature 1..23: note = Synthetic Construct
  source 1..23: mol_type = other DNA
agtccagacctctttccaagaca

SEQ ID NO: 43893 - DNA, 24 bp, synthetic construct
  misc_feature 1..24: note = Synthetic Construct
  source 1..24: mol_type = other DNA
ccagtctctttcctttcaccgtta

SEQ ID NO: 43894 - DNA, 23 bp, synthetic construct
  misc_feature 1..23: note = Synthetic Construct
  source 1..23: mol_type = other DNA
ccactgttcaagtgagccctgta

SEQ ID NO: 43895 - DNA, 20 bp, synthetic construct
  misc_feature 1..20: note = Synthetic Construct
  source 1..20: mol_type = other DNA
tgcacagcctggatggttct

SEQ ID NO: 43896 - DNA, 19 bp, synthetic construct
  misc_feature 1..19: note = Synthetic Construct
  source 1..19: mol_type = other DNA
gccatgccttgcacacaga

SEQ ID NO: 43897 - DNA, 24 bp, synthetic construct
  misc_feature 1..24: note = Synthetic Construct
  source 1..24: mol_type = other DNA
gggaccttgacactgactctcttc

SEQ ID NO: 43898 - DNA, 21 bp, synthetic construct
  misc_feature 1..21: note = Synthetic Construct
  source 1..21: mol_type = other DNA
acatccgcccctcttctcctt

SEQ ID NO: 43899 - DNA, 22 bp, synthetic construct
  misc_feature 1..22: note = Synthetic Construct
  source 1..22: mol_type = other DNA
tggtggaaagaggtggcaatag

SEQ ID NO: 43900 - DNA, 22 bp, synthetic construct
  misc_feature 1..22: note = Synthetic Construct
  source 1..22: mol_type = other DNA
agctagtgccctcttgcacaac

SEQ ID NO: 43901 - DNA, 20 bp, synthetic construct
  misc_feature 1..20: note = Synthetic Construct
  source 1..20: mol_type = other DNA
tccccatgccaccctgcata

SEQ ID NO: 43902 - DNA, 28 bp, synthetic construct
  misc_feature 1..28: note = Synthetic Construct
  source 1..28: mol_type = other DNA
ccactggatagaagaagttccccacata

SEQ ID NO: 43903 - DNA, 22 bp, synthetic construct
  misc_feature 1..22: note = Synthetic Construct
  source 1..22: mol_type = other DNA
gctggtttgcggatggatgtct

SEQ ID NO: 43904 - DNA, 20 bp, synthetic construct
  misc_feature 1..20: note = Synthetic Construct
  source 1..20: mol_type = other DNA
atgaccaggtcggagcgttt

SEQ ID NO: 43905 - DNA, 22 bp, synthetic construct
  misc_feature 1..22: note = Synthetic Construct
  source 1..22: mol_type = other DNA
agtccggaatatcagccccata

SEQ ID NO: 43906 - DNA, 20 bp, synthetic construct
  misc_feature 1..20: note = Synthetic Construct
  source 1..20: mol_type = other DNA
gcgtctgaccctgtgtggtt

SEQ ID NO: 43907 - DNA, 21 bp, synthetic construct
  misc_feature 1..21: note = Synthetic Construct
  source 1..21: mol_type = other DNA
tcctcccttctggctgtctac

SEQ ID NO: 43908 - DNA, 22 bp, synthetic construct
  misc_feature 1..22: note = Synthetic Construct
  source 1..22: mol_type = other DNA
accctgactttggagggacaca

SEQ ID NO: 43909 - DNA, 20 bp, synthetic construct
  misc_feature 1..20: note = Synthetic Construct
  source 1..20: mol_type = other DNA
ggtagcctggggcaagtttt

SEQ ID NO: 43910 - DNA, 26 bp, synthetic construct
  misc_feature 1..26: note = Synthetic Construct
  source 1..26: mol_type = other DNA
gaatctaacaagtcacccagttccta

SEQ ID NO: 43911 - DNA, 22 bp, synthetic construct
  misc_feature 1..22: note = Synthetic Construct
  source 1..22: mol_type = other DNA
cccgtagtcacaaacccctaca

SEQ ID NO: 43912 - DNA, 24 bp, synthetic construct
  misc_feature 1..24: note = Synthetic Construct
  source 1..24: mol_type = other DNA
gcctggcttaaaataagtgcttga

SEQ ID NO: 43913 - DNA, 22 bp, synthetic construct
  misc_feature 1..22: note = Synthetic Construct
  source 1..22: mol_type = other DNA
agcaaccatgttaggtgccatt

SEQ ID NO: 43914 - DNA, 22 bp, synthetic construct
  misc_feature 1..22: note = Synthetic Construct
  source 1..22: mol_type = other DNA
ttttgtgagcccctggttagtt

SEQ ID NO: 43915 - DNA, 27 bp, synthetic construct
  misc_feature 1..27: note = Synthetic Construct
  source 1..27: mol_type = other DNA
gggcacctttactcatcctaccagata

SEQ ID NO: 43916 - DNA, 21 bp, synthetic construct
  misc_feature 1..21: note = Synthetic Construct
  source 1..21: mol_type = other DNA
tagccaccctgcagaccttgt

SEQ ID NO: 43917 - DNA, 21 bp, synthetic construct
  misc_feature 1..21: note = Synthetic Construct
  source 1..21: mol_type = other DNA
actggccagaagtgcctattc

SEQ ID NO: 43918 - DNA, 23 bp, synthetic construct
  misc_feature 1..23: note = Synthetic Construct
  source 1..23: mol_type = other DNA
cgttttcttgcctccagttggtt

SEQ ID NO: 43919 - DNA, 20 bp, synthetic construct
  misc_feature 1..20: note = Synthetic Construct
  source 1..20: mol_type = other DNA
ctacaggcacacgctaccat

SEQ ID NO: 43920 - DNA, 20 bp, synthetic construct
  misc_feature 1..20: note = Synthetic Construct
  source 1..20: mol_type = other DNA
gcccaacgctcagacagaca

SEQ ID NO: 43921 - DNA, 23 bp, synthetic construct
  misc_feature 1..23: note = Synthetic Construct
  source 1..23: mol_type = other DNA
gagggttagtggactctggtcta

SEQ ID NO: 43922 - DNA, 25 bp, synthetic construct
  misc_feature 1..25: note = Synthetic Construct
  source 1..25: mol_type = other DNA
acaacagagttagcagttcttcaca

SEQ ID NO: 43923 - DNA, 20 bp, synthetic construct
  misc_feature 1..20: note = Synthetic Construct
  source 1..20: mol_type = other DNA
ccccagatgccaagaacctt

SEQ ID NO: 43924 - DNA, 20 bp, synthetic construct
  misc_feature 1..20: note = Synthetic Construct
  source 1..20: mol_type = other DNA
aaggcacgtatggcctcaac

SEQ ID NO: 43925 - DNA, 25 bp, synthetic construct
  misc_feature 1..25: note = Synthetic Construct
  source 1..25: mol_type = other DNA
caaccagaaagcactcattcctaac

SEQ ID NO: 43926 - DNA, 22 bp, synthetic construct
  misc_feature 1..22: note = Synthetic Construct
  source 1..22: mol_type = other DNA
gcacttggcaggcacctagtat

SEQ ID NO: 43927 - DNA, 23 bp, synthetic construct
  misc_feature 1..23: note = Synthetic Construct
  source 1..23: mol_type = other DNA
ggtgaagagccaatcaggccata

SEQ ID NO: 43928 - DNA, 20 bp, synthetic construct
  misc_feature 1..20: note = Synthetic Construct
  source 1..20: mol_type = other DNA
atccccaaagtggccacaac

SEQ ID NO: 43929 - DNA, 19 bp, synthetic construct
  misc_feature 1..19: note = Synthetic Construct
  source 1..19: mol_type = other DNA
ggcgcacttcatgctgcaa

SEQ ID NO: 43930 - DNA, 26 bp, synthetic construct
  misc_feature 1..26: note = Synthetic Construct
  source 1..26: mol_type = other DNA
ccatcgtgactatctcatgggtgatg

SEQ ID NO: 43931 - DNA, 23 bp, synthetic construct
  misc_feature 1..23: note = Synthetic Construct
  source 1..23: mol_type = other DNA
gggaggtcctgttgctaatgttg

SEQ ID NO: 43932 - DNA, 28 bp, synthetic construct
  misc_feature 1..28: note = Synthetic Construct
  source 1..28: mol_type = other DNA
ggactatgttctgtgtcctccttttgaa

SEQ ID NO: 43933 - DNA, 20 bp, synthetic construct
  misc_feature 1..20: note = Synthetic Construct
  source 1..20: mol_type = other DNA
tccactgggaggctgggaaa

SEQ ID NO: 43934 - DNA, 21 bp, synthetic construct
  misc_feature 1..21: note = Synthetic Construct
  source 1..21: mol_type = other DNA
ccagtttggtgacggggctta

SEQ ID NO: 43935 - DNA, 21 bp, synthetic construct
  misc_feature 1..21: note = Synthetic Construct
  source 1..21: mol_type = other DNA
tggctccagtcttcccagcta

SEQ ID NO: 43936 - DNA, 19 bp, synthetic construct
  misc_feature 1..19: note = Synthetic Construct
  source 1..19: mol_type = other DNA
actcgagcccgctgctgtt

SEQ ID NO: 43937 - DNA, 24 bp, synthetic construct
  misc_feature 1..24: note = Synthetic Construct
  source 1..24: mol_type = other DNA
cccttgttgtccttcctcgtctgt

SEQ ID NO: 43938 - DNA, 20 bp, synthetic construct
  misc_feature 1..20: note = Synthetic Construct
  source 1..20: mol_type = other DNA
gccaactctcagccaccaaa

SEQ ID NO: 43939 - DNA, 22 bp, synthetic construct
  misc_feature 1..22: note = Synthetic Construct
  source 1..22: mol_type = other DNA
gggcgcaagtaccggtataaca

SEQ ID NO: 43940 - DNA, 24 bp, synthetic construct
  misc_feature 1..24: note = Synthetic Construct
  source 1..24: mol_type = other DNA
aggcagtctctcagtgtaaagaag

SEQ ID NO: 43941 - DNA, 27 bp, synthetic construct
  misc_feature 1..27: note = Synthetic Construct
  source 1..27: mol_type = other DNA
cccttggttcccatactgtaaacaaca

SEQ ID NO: 43942 - DNA, 21 bp, synthetic construct
  misc_feature 1..21: note = Synthetic Construct
  source 1..21: mol_type = other DNA
cccctgttgtgctgagagttt

SEQ ID NO: 43943 - DNA, 26 bp, synthetic construct
  misc_feature 1..26: note = Synthetic Construct
  source 1..26: mol_type = other DNA
gaactgataaacagtgtcccatctct

SEQ ID NO: 43944 - DNA, 22 bp, synthetic construct
  misc_feature 1..22: note = Synthetic Construct
  source 1..22: mol_type = other DNA
tcccacggagagtgaagagaaa

SEQ ID NO: 43945 - DNA, 18 bp, synthetic construct
  misc_feature 1..18: note = Synthetic Construct
  source 1..18: mol_type = other DNA
tggctgcaggcgtcactt

SEQ ID NO: 43946 - DNA, 21 bp, synthetic construct
  misc_feature 1..21: note = Synthetic Construct
  source 1..21: mol_type = other DNA
actgcctcgaatcagccaatg

SEQ ID NO: 43947 - DNA, 22 bp, synthetic construct
  misc_feature 1..22: note = Synthetic Construct
  source 1..22: mol_type = other DNA
tcctcactccattccctccatt

SEQ ID NO: 43948 - DNA, 22 bp, synthetic construct
  misc_feature 1..22: note = Synthetic Construct
  source 1..22: mol_type = other DNA
tccctgctggttctgccttaga

SEQ ID NO: 43949 - DNA, 23 bp, synthetic construct
  misc_feature 1..23: note = Synthetic Construct
  source 1..23: mol_type = other DNA
gtcacgggtacagcacatagtct

SEQ ID NO: 43950 - DNA, 22 bp, synthetic construct
  misc_feature 1..22: note = Synthetic Construct
  source 1..22: mol_type = other DNA
cactgtgttgggccctgaaata

SEQ ID NO: 43951 - DNA, 20 bp, synthetic construct
  misc_feature 1..20: note = Synthetic Construct
  source 1..20: mol_type = other DNA
aggctggagccataggatca

SEQ ID NO: 43952 - DNA, 21 bp, synthetic construct
  misc_feature 1..21: note = Synthetic Construct
  source 1..21: mol_type = other DNA
agcctagggctctcaaactct

SEQ ID NO: 43953 - DNA, 22 bp, synthetic construct
  misc_feature 1..22: note = Synthetic Construct
  source 1..22: mol_type = other DNA
ggctttaacatgcccacgagat

SEQ ID NO: 43954 - DNA, 21 bp, synthetic construct
  misc_feature 1..21: note = Synthetic Construct
  source 1..21: mol_type = other DNA
caaggcagggattgaggcaaa

SEQ ID NO: 43955 - DNA, 20 bp, synthetic construct
  misc_feature 1..20: note = Synthetic Construct
  source 1..20: mol_type = other DNA
aaaacggcggggtgggcaaa

SEQ ID NO: 43956 - DNA, 22 bp, synthetic construct
  misc_feature 1..22: note = Synthetic Construct
  source 1..22: mol_type = other DNA
cctcaggagacagatgcagtga

SEQ ID NO: 43957 - DNA, 25 bp, synthetic construct
  misc_feature 1..25: note = Synthetic Construct
  source 1..25: mol_type = other DNA
gctttaaagatcacatgctgccatt

SEQ ID NO: 43958 - DNA, 22 bp, synthetic construct
  misc_feature 1..22: note = Synthetic Construct
  source 1..22: mol_type = other DNA
ggagtcaaagcttccacgtagt

SEQ ID NO: 43959 - DNA, 18 bp, synthetic construct
  misc_feature 1..18: note = Synthetic Construct
  source 1..18: mol_type = other DNA
agcctgtggcgctttgtt

SEQ ID NO: 43960 - DNA, 19 bp, synthetic construct
  misc_feature 1..19: note = Synthetic Construct
  source 1..19: mol_type = other DNA
ccggcatgcagacactcaa

SEQ ID NO: 43961 - DNA, 26 bp, synthetic construct
  misc_feature 1..26: note = Synthetic Construct
  source 1..26: mol_type = other DNA
tcggatagatcttataccacctgtgt

SEQ ID NO: 43962 - DNA, 22 bp, synthetic construct
  misc_feature 1..22: note = Synthetic Construct
  source 1..22: mol_type = other DNA
gaggcacggtagacatttcctt

SEQ ID NO: 43963 - DNA, 21 bp, synthetic construct
  misc_feature 1..21: note = Synthetic Construct
  source 1..21: mol_type = other DNA
tgtttctgcaagcctcagtgt

SEQ ID NO: 43964 - DNA, 26 bp, synthetic construct
  misc_feature 1..26: note = Synthetic Construct
  source 1..26: mol_type = other DNA
ccctacagacagtagtccctttattg

SEQ ID NO: 43965 - DNA, 22 bp, synthetic construct
  misc_feature 1..22: note = Synthetic Construct
  source 1..22: mol_type = other DNA
tggcacctatgactgacacttg

SEQ ID NO: 43966 - DNA, 23 bp, synthetic construct
  misc_feature 1..23: note = Synthetic Construct
  source 1..23: mol_type = other DNA
cggagagatgaagtggtttgctt

SEQ ID NO: 43967 - DNA, 19 bp, synthetic construct
  misc_feature 1..19: note = Synthetic Construct
  source 1..19: mol_type = other DNA
agctggggtgggcagacta

SEQ ID NO: 43968 - DNA, 19 bp, synthetic construct
  misc_feature 1..19: note = Synthetic Construct
  source 1..19: mol_type = other DNA
cccttctcaggcggtgctt

SEQ ID NO: 43969 - DNA, 20 bp, synthetic construct
  misc_feature 1..20: note = Synthetic Construct
  source 1..20: mol_type = other DNA
cgtaggcagccttccacgta

SEQ ID NO: 43970 - DNA, 26 bp, synthetic construct
  misc_feature 1..26: note = Synthetic Construct
  source 1..26: mol_type = other DNA
cacatgctattcccttatgcctggta

SEQ ID NO: 43971 - DNA, 26 bp, synthetic construct
  misc_feature 1..26: note = Synthetic Construct
  source 1..26: mol_type = other DNA
ccttcagtatctccacacccacttct

SEQ ID NO: 43972 - DNA, 20 bp, synthetic construct
  misc_feature 1..20: note = Synthetic Construct
  source 1..20: mol_type = other DNA
ctgggcacccagctaaactt

SEQ ID NO: 43973 - DNA, 23 bp, synthetic construct
  misc_feature 1..23: note = Synthetic Construct
  source 1..23: mol_type = other DNA
cccctgactgatgtgtccagaga

SEQ ID NO: 43974 - DNA, 25 bp, synthetic construct
  misc_feature 1..25: note = Synthetic Construct
  source 1..25: mol_type = other DNA
gcacagtctggaaaccagtcgtcta

SEQ ID NO: 43975 - DNA, 20 bp, synthetic construct
  misc_feature 1..20: note = Synthetic Construct
  source 1..20: mol_type = other DNA
agtgccagacagccctgaac

SEQ ID NO: 43976 - DNA, 23 bp, synthetic construct
  misc_feature 1..23: note = Synthetic Construct
  source 1..23: mol_type = other DNA
acagactacagccaagcaatgat

SEQ ID NO: 43977 - DNA, 25 bp, synthetic construct
  misc_feature 1..25: note = Synthetic Construct
  source 1..25: mol_type = other DNA
ggtactgatctgctgtcactggaaa

SEQ ID NO: 43978 - DNA, 25 bp, synthetic construct
  misc_feature 1..25: note = Synthetic Construct
  source 1..25: mol_type = other DNA
tggcaccatttcagtgacattaaac

SEQ ID NO: 43979 - DNA, 26 bp, synthetic construct
  misc_feature 1..26: note = Synthetic Construct
  source 1..26: mol_type = other DNA
gattgagaagcagtagtagcaggtat

SEQ ID NO: 43980 - DNA, 19 bp, synthetic construct
  misc_feature 1..19: note = Synthetic Construct
  source 1..19: mol_type = other DNA
tccagcagctgtgctcgat

SEQ ID NO: 43981 - DNA, 24 bp, synthetic construct
  misc_feature 1..24: note = Synthetic Construct
  source 1..24: mol_type = other DNA
ctagaggcaatacactccacactt

SEQ ID NO: 43982 - DNA, 20 bp, synthetic construct
  misc_feature 1..20: note = Synthetic Construct
  source 1..20: mol_type = other DNA
acaccgcattgactgacaca

SEQ ID NO: 43983 - DNA, 22 bp, synthetic construct
  misc_feature 1..22: note = Synthetic Construct
  source 1..22: mol_type = other DNA
gctgcacttgcagggatctaac

SEQ ID NO: 43984 - DNA, 20 bp, synthetic construct
  misc_feature 1..20: note = Synthetic Construct
  source 1..20: mol_type = other DNA
tgctggagtgagcggagtgt

SEQ ID NO: 43985 - DNA, 24 bp, synthetic construct
  misc_feature 1..24: note = Synthetic Construct
  source 1..24: mol_type = other DNA
ctgtttatctcagcccacatggta

SEQ ID NO: 43986 - DNA, 20 bp, synthetic construct
  misc_feature 1..20: note = Synthetic Construct
  source 1..20: mol_type = other DNA
ccacccaaagaacccgaaga

SEQ ID NO: 43987 - DNA, 21 bp, synthetic construct
  misc_feature 1..21: note = Synthetic Construct
  source 1..21: mol_type = other DNA
cacagaccaggttcagcatca

SEQ ID NO: 43988 - DNA, 22 bp, synthetic construct
  misc_feature 1..22: note = Synthetic Construct
  source 1..22: mol_type = other DNA
ggcccatcagattctgcacttg

SEQ ID NO: 43989 - DNA, 19 bp, synthetic construct
  misc_feature 1..19: note = Synthetic Construct
  source 1..19: mol_type = other DNA
ttgtgcctcccaggtctca

SEQ ID NO: 43990 - DNA, 19 bp, synthetic construct
  misc_feature 1..19: note = Synthetic Construct
  source 1..19: mol_type = other DNA
ttgccatgaaccgccttct

SEQ ID NO: 43991 - DNA, 20 bp, synthetic construct
  misc_feature 1..20: note = Synthetic Construct
  source 1..20: mol_type = other DNA
ccgcacggccctatctcatc

SEQ ID NO: 43992 - DNA, 23 bp, synthetic construct
  misc_feature 1..23: note = Synthetic Construct
  source 1..23: mol_type = other DNA
cagagagccacaggaaccactaa

SEQ ID NO: 43993 - DNA, 20 bp, synthetic construct
  misc_feature 1..20: note = Synthetic Construct
  source 1..20: mol_type = other DNA
tgtcacagcctcggaagcaa

SEQ ID NO: 43994 - DNA, 23 bp, synthetic construct
  misc_feature 1..23: note = Synthetic Construct
  source 1..23: mol_type = other DNA
ggaagagtgttggtttgctctca

SEQ ID NO: 43995 - DNA, 18 bp, synthetic construct
  misc_feature 1..18: note = Synthetic Construct
  source 1..18: mol_type = other DNA
aggcctatggggcacagt

SEQ ID NO: 43996 - DNA, 19 bp, synthetic construct
  misc_feature 1..19: note = Synthetic Construct
  source 1..19: mol_type = other DNA
ccaggccagggagtgaaca

SEQ ID NO: 43997 - DNA, 20 bp, synthetic construct
  misc_feature 1..20: note = Synthetic Construct
  source 1..20: mol_type = other DNA
tggcacacaccacaccttag

SEQ ID NO: 43998 - DNA, 20 bp, synthetic construct
  misc_feature 1..20: note = Synthetic Construct
  source 1..20: mol_type = other DNA
ccttgtggccttggttcaga

SEQ ID NO: 43999 - DNA, 22 bp, synthetic construct
  misc_feature 1..22: note = Synthetic Construct
  source 1..22: mol_type = other DNA
cccaacttgcccagtcctcttt

SEQ ID NO: 44000 - DNA, 20 bp, synthetic construct
  misc_feature 1..20: note = Synthetic Construct
  source 1..20: mol_type = other DNA
gcagtcagcagagtgtccat

SEQ ID NO: 44001 - DNA, 20 bp, synthetic construct
  misc_feature 1..20: note = Synthetic Construct
  source 1..20: mol_type = other DNA
agggcttggagggctccttt

SEQ ID NO: 44002 - DNA, 20 bp, synthetic construct
  misc_feature 1..20: note = Synthetic Construct
  source 1..20: mol_type = other DNA
tggggtctccccttgcattt

SEQ ID NO: 44003 - DNA, 24 bp, synthetic construct
  misc_feature 1..24: note = Synthetic Construct
  source 1..24: mol_type = other DNA
cggggataaacacttcctcctctt

SEQ ID NO: 44004 - DNA, 27 bp, synthetic construct
  misc_feature 1..27: note = Synthetic Construct
  source 1..27: mol_type = other DNA
cgaactttcagtaaatacctgctgact

SEQ ID NO: 44005 - DNA, 19 bp, synthetic construct
  misc_feature 1..19: note = Synthetic Construct
  source 1..19: mol_type = other DNA
accctgggcaaggtcatct

SEQ ID NO: 44006 - DNA, 25 bp, synthetic construct
  misc_feature 1..25: note = Synthetic Construct
  source 1..25: mol_type = other DNA
ctggaagagagcacaagaggttgat

SEQ ID NO: 44007 - DNA, 20 bp, synthetic construct
  misc_feature 1..20: note = Synthetic Construct
  source 1..20: mol_type = other DNA
ccgctgcatgtttggtgcat

SEQ ID NO: 44008 - DNA, 25 bp, synthetic construct
  misc_feature 1..25: note = Synthetic Construct
  source 1..25: mol_type = other DNA
ggagactggtcaggaatacctccta

SEQ ID NO: 44009 - DNA, 24 bp, synthetic construct
  misc_feature 1..24: note = Synthetic Construct
  source 1..24: mol_type = other DNA
gttcatgtgtttgccagagacttc

SEQ ID NO: 44010 - DNA, 22 bp, synthetic construct
  misc_feature 1..22: note = Synthetic Construct
  source 1..22: mol_type = other DNA
gaggctcagaggagttgacttg

SEQ ID NO: 44011 - DNA, 18 bp, synthetic construct
  misc_feature 1..18: note = Synthetic Construct
  source 1..18: mol_type = other DNA
tggccacctcacgacctt

SEQ ID NO: 44012 - DNA, 22 bp, synthetic construct
  misc_feature 1..22: note = Synthetic Construct
  source 1..22: mol_type = other DNA
gctccagctgtacctacgtcaa

SEQ ID NO: 44013 - DNA, 21 bp, synthetic construct
  misc_feature 1..21: note = Synthetic Construct
  source 1..21: mol_type = other DNA
gcagagagaggtgccagaaat

SEQ ID NO: 44014 - DNA, 26 bp, synthetic construct
  misc_feature 1..26: note = Synthetic Construct
  source 1..26: mol_type = other DNA
gcatttttatctagcctgcctcgtat

SEQ ID NO: 44015 - DNA, 19 bp, synthetic construct
  misc_feature 1..19: note = Synthetic Construct
  source 1..19: mol_type = other DNA
ccacccacctccccacttt

SEQ ID NO: 44016 - DNA, 22 bp, synthetic construct
  misc_feature 1..22: note = Synthetic Construct
  source 1..22: mol_type = other DNA
tgtcacacccacctcccattag

SEQ ID NO: 44017 - DNA, 25 bp, synthetic construct
  misc_feature 1..25: note = Synthetic Construct
  source 1..25: mol_type = other DNA
ggcaaaagtaaacacctgactcact

SEQ ID NO: 44018 - DNA, 20 bp, synthetic construct
  misc_feature 1..20: note = Synthetic Construct
  source 1..20: mol_type = other DNA
tgcagcgtttgacccacact

SEQ ID NO: 44019 - DNA, 25 bp, synthetic construct
  misc_feature 1..25: note = Synthetic Construct
  source 1..25: mol_type = other DNA
attggatcatcagatttggggaact

SEQ ID NO: 44020 - DNA, 26 bp, synthetic construct
  misc_feature 1..26: note = Synthetic Construct
  source 1..26: mol_type = other DNA
gtgagagacctggaaatgcctgatag

SEQ ID NO: 44021 - DNA, 22 bp, synthetic construct
  misc_feature 1..22: note = Synthetic Construct
  source 1..22: mol_type = other DNA
caagggacccaaaatgccctta

SEQ ID NO: 44022 - DNA, 22 bp, synthetic construct
  misc_feature 1..22: note = Synthetic Construct
  source 1..22: mol_type = other DNA
caccaggcctttgcttgtccta

SEQ ID NO: 44023 - DNA, 22 bp, synthetic construct
  misc_feature 1..22: note = Synthetic Construct
  source 1..22: mol_type = other DNA
gcaggtaaggagtcccttggaa

SEQ ID NO: 44024 - DNA, 24 bp, synthetic construct
  misc_feature 1..24: note = Synthetic Construct
  source 1..24: mol_type = other DNA
tgaacagtctgcatgaaacacttg

SEQ ID NO: 44025 - DNA, 22 bp, synthetic construct
  misc_feature 1..22: note = Synthetic Construct
  source 1..22: mol_type = other DNA
tccctcgtggggtgtatagtct

SEQ ID NO: 44026 - DNA, 21 bp, synthetic construct
  misc_feature 1..21: note = Synthetic Construct
  source 1..21: mol_type = other DNA
ccctctgcctcatggtacaag

SEQ ID NO: 44027 - DNA, 20 bp, synthetic construct
  misc_feature 1..20: note = Synthetic Construct
  source 1..20: mol_type = other DNA
tacctgggcacctgtgaaga

SEQ ID NO: 44028 - DNA, 22 bp, synthetic construct
  misc_feature 1..22: note = Synthetic Construct
  source 1..22: mol_type = other DNA
ctccttgaggtctggtcgatct

SEQ ID NO: 44029 - DNA, 22 bp, synthetic construct
  misc_feature 1..22: note = Synthetic Construct
  source 1..22: mol_type = other DNA
gttccaaaggccaccatggatt

SEQ ID NO: 44030 - DNA, 24 bp, synthetic construct
  misc_feature 1..24: note = Synthetic Construct
  source 1..24: mol_type = other DNA
ttcctgagggtcatcctaaacaac

SEQ ID NO: 44031 - DNA, 20 bp, synthetic construct
  misc_feature 1..20: note = Synthetic Construct
  source 1..20: mol_type = other DNA
tggttgtggctgagggtctt

SEQ ID NO: 44032 - DNA, 26 bp, synthetic construct
  misc_feature 1..26: note = Synthetic Construct
  source 1..26: mol_type = other DNA
ggctgcatagggtaaatcacggttag

SEQ ID NO: 44033 - DNA, 24 bp, synthetic construct
  misc_feature 1..24: note = Synthetic Construct
  source 1..24: mol_type = other DNA
cccatggaaaagagggcactgtca

SEQ ID NO: 44034 - DNA, 25 bp, synthetic construct
  misc_feature 1..25: note = Synthetic Construct
  source 1..25: mol_type = other DNA
gcagaacaatgtactctccctaagt

SEQ ID NO: 44035 - DNA, 19 bp, synthetic construct
  misc_feature 1..19: note = Synthetic Construct
  source 1..19: mol_type = other DNA
agtggagcacagccagtgt

SEQ ID NO: 44036 - DNA, 19 bp, synthetic construct
  misc_feature 1..19: note = Synthetic Construct
  source 1..19: mol_type = other DNA
ccttggggttgggctcaga

SEQ ID NO: 44037 - DNA, 20 bp, synthetic construct
  misc_feature 1..20: note = Synthetic Construct
  source 1..20: mol_type = other DNA
ctgtgccgcgtgtgacattt

SEQ ID NO: 44038 - DNA, 24 bp, synthetic construct
  misc_feature 1..24: note = Synthetic Construct
  source 1..24: mol_type = other DNA
cccttgtgtgacatgggtaagaag

SEQ ID NO: 44039 - DNA, 21 bp, synthetic construct
  misc_feature 1..21: note = Synthetic Construct
  source 1..21: mol_type = other DNA
ggccagatctgctcaccctaa

SEQ ID NO: 44040 - DNA, 23 bp, synthetic construct
  misc_feature 1..23: note = Synthetic Construct
  source 1..23: mol_type = other DNA
cttgttttcaaggcagggaggaa

SEQ ID NO: 44041 - DNA, 21 bp, synthetic construct
  misc_feature 1..21: note = Synthetic Construct
  source 1..21: mol_type = other DNA
agacttggggagccaatctga

SEQ ID NO: 44042 - DNA, 25 bp, synthetic construct
  misc_feature 1..25: note = Synthetic Construct
  source 1..25: mol_type = other DNA
cgtgatcttgagaagcagccaaaac

SEQ ID NO: 44043 - DNA, 24 bp, synthetic construct
  misc_feature 1..24: note = Synthetic Construct
  source 1..24: mol_type = other DNA
caccattactcccagtgacctact

SEQ ID NO: 44044 - DNA, 27 bp, synthetic construct
  misc_feature 1..27: note = Synthetic Construct
  source 1..27: mol_type = other DNA
gaggagagacacaacttatgctttttg

SEQ ID NO: 44045 - DNA, 20 bp, synthetic construct
  misc_feature 1..20: note = Synthetic Construct
  source 1..20: mol_type = other DNA
tgctccatgcaggtctgtgt

SEQ ID NO: 44046 - DNA, 24 bp, synthetic construct
  misc_feature 1..24: note = Synthetic Construct
  source 1..24: mol_type = other DNA
ggcagattatcccgttaaccttgt

SEQ ID NO: 44047 - DNA, 19 bp, synthetic construct
  misc_feature 1..19: note = Synthetic Construct
  source 1..19: mol_type = other DNA
tccgccctgccacatgcaa

SEQ ID NO: 44048 - DNA, 21 bp, synthetic construct
  misc_feature 1..21: note = Synthetic Construct
  source 1..21: mol_type = other DNA
agaagaggggctatgccatga

SEQ ID NO: 44049 - DNA, 26 bp, synthetic construct
  misc_feature 1..26: note = Synthetic Construct
  source 1..26: mol_type = other DNA
ccagggttcactgagatgtagtgtgt

SEQ ID NO: 44050 - DNA, 24 bp, synthetic construct
  misc_feature 1..24: note = Synthetic Construct
  source 1..24: mol_type = other DNA
gagaaggctctaagcactcacctt

SEQ ID NO: 44051 - DNA, 26 bp, synthetic construct
  misc_feature 1..26: note = Synthetic Construct
  source 1..26: mol_type = other DNA
ggtcctagttttcaatgcccacatac

SEQ ID NO: 44052 - DNA, 23 bp, synthetic construct
  misc_feature 1..23: note = Synthetic Construct
  source 1..23: mol_type = other DNA
agatgagtggtgagtggcttttg

SEQ ID NO: 44053 - DNA, 21 bp, synthetic construct
  misc_feature 1..21: note = Synthetic Construct
  source 1..21: mol_type = other DNA
tgctgtccctccagtgctctt

SEQ ID NO: 44054 - DNA, 23 bp, synthetic construct
  misc_feature 1..23: note = Synthetic Construct
  source 1..23: mol_type = other DNA
ctcactgatgatggtggcagttc

SEQ ID NO: 44055 - DNA, 20 bp, synthetic construct
  misc_feature 1..20: note = Synthetic Construct
  source 1..20: mol_type = other DNA
tcacccacactggacgtact

SEQ ID NO: 44056 - DNA, 21 bp, synthetic construct
  misc_feature 1..21: note = Synthetic Construct
  source 1..21: mol_type = other DNA
acccaggatcaaggtgtcagt

SEQ ID NO: 44057 - DNA, 30 bp, synthetic construct
  misc_feature 1..30: note = Synthetic Construct
  source 1..30: mol_type = other DNA
ggaaatgtgttctaccttgtaactgggata

SEQ ID NO: 44058 - DNA, 25 bp, synthetic construct
  misc_feature 1..25: note = Synthetic Construct
  source 1..25: mol_type = other DNA
cctggtaggaagatccacaaagcat

SEQ ID NO: 44059 - DNA, 24 bp, synthetic construct
  misc_feature 1..24: note = Synthetic Construct
  source 1..24: mol_type = other DNA
cagtctaggacacaaagagtgcaa

SEQ ID NO: 44060 - DNA, 25 bp, synthetic construct
  misc_feature 1..25: note = Synthetic Construct
  source 1..25: mol_type = other DNA
ccagcatgtctctcagaggccattt

SEQ ID NO: 44061 - DNA, 20 bp, synthetic construct
  misc_feature 1..20: note = Synthetic Construct
  source 1..20: mol_type = other DNA
aagggagctgcatggcagaa

SEQ ID NO: 44062 - DNA, 24 bp, synthetic construct
  misc_feature 1..24: note = Synthetic Construct
  source 1..24: mol_type = other DNA
aactacaaacacacacctggaaga

SEQ ID NO: 44063 - DNA, 22 bp, synthetic construct
  misc_feature 1..22: note = Synthetic Construct
  source 1..22: mol_type = other DNA
tctgcatgagcttgaactcgaa

SEQ ID NO: 44064 - DNA, 19 bp, synthetic construct
  misc_feature 1..19: note = Synthetic Construct
  source 1..19: mol_type = other DNA
agagcagcagcacggtagt

SEQ ID NO: 44065 - DNA, 19 bp, synthetic construct
  misc_feature 1..19: note = Synthetic Construct
  source 1..19: mol_type = other DNA
tcgggctcgggcttgaaat

SEQ ID NO: 44066 - DNA, 20 bp, synthetic construct
  misc_feature 1..20: note = Synthetic Construct
  source 1..20: mol_type = other DNA
tccatgccattgctgagtgt

SEQ ID NO: 44067 - DNA, 22 bp, synthetic construct
  misc_feature 1..22: note = Synthetic Construct
  source 1..22: mol_type = other DNA
aagcccacccaggatcaagaga

SEQ ID NO: 44068 - DNA, 22 bp, synthetic construct
  misc_feature 1..22: note = Synthetic Construct
  source 1..22: mol_type = other DNA
gatgcaacaccctcgagttcta

SEQ ID NO: 44069 - DNA, 21 bp, synthetic construct
  misc_feature 1..21: note = Synthetic Construct
  source 1..21: mol_type = other DNA
ccagccatcttggggcttcta

SEQ ID NO: 44070 - DNA, 25 bp, synthetic construct
  misc_feature 1..25: note = Synthetic Construct
  source 1..25: mol_type = other DNA
ctgggtagtcaaggtcaattcaaac

SEQ ID NO: 44071 - DNA, 21 bp, synthetic construct
  misc_feature 1..21: note = Synthetic Construct
  source 1..21: mol_type = other DNA
aacggaggacccacgctaact

SEQ ID NO: 44072 - DNA, 20 bp, synthetic construct
  misc_feature 1..20: note = Synthetic Construct
  source 1..20: mol_type = other DNA
aactaggccccggttctgta

SEQ ID NO: 44073 - DNA, 26 bp, synthetic construct
  misc_feature 1..26: note = Synthetic Construct
  source 1..26: mol_type = other DNA
gattgaaatctacctggctccaaatc

SEQ ID NO: 44074 - DNA, 22 bp, synthetic construct
  misc_feature 1..22: note = Synthetic Construct
  source 1..22: mol_type = other DNA
gcagtgtttggtgggacacaga

SEQ ID NO: 44075 - DNA, 22 bp, synthetic construct
  misc_feature 1..22: note = Synthetic Construct
  source 1..22: mol_type = other DNA
ttgccctccaggtctctacctt

SEQ ID NO: 44076 - DNA, 25 bp, synthetic construct
  misc_feature 1..25: note = Synthetic Construct
  source 1..25: mol_type = other DNA
gcagatagtggacaatgaggcgaat

SEQ ID NO: 44077 - DNA, 20 bp, synthetic construct
  misc_feature 1..20: note = Synthetic Construct
  source 1..20: mol_type = other DNA
gtcctccacttgcacaccaa

SEQ ID NO: 44078 - DNA, 19 bp, synthetic construct
  misc_feature 1..19: note = Synthetic Construct
  source 1..19: mol_type = other DNA
gttgcagcatggggctagt

SEQ ID NO: 44079 - DNA, 25 bp, synthetic construct
  misc_feature 1..25: note = Synthetic Construct
  source 1..25: mol_type = other DNA
ggggtttgacttgagtaactgagat

SEQ ID NO: 44080 - DNA, 25 bp, synthetic construct
  misc_feature 1..25: note = Synthetic Construct
  source 1..25: mol_type = other DNA
gggtgttccctaaggaagtggtttc

SEQ ID NO: 44081 - DNA, 21 bp, synthetic construct
  misc_feature 1..21: note = Synthetic Construct
  source 1..21: mol_type = other DNA
cagcttggcaaagacgagaag

SEQ ID NO: 44082 - DNA, 27 bp, synthetic construct
  misc_feature 1..27: note = Synthetic Construct
  source 1..27: mol_type = other DNA
cacctcttctttgattccctgggatag

SEQ ID NO: 44083 - DNA, 23 bp, synthetic construct
  misc_feature 1..23: note = Synthetic Construct
  source 1..23: mol_type = other DNA
ccttcagtccagctgaccacttc

SEQ ID NO: 44084 - DNA, 22 bp, synthetic construct
  misc_feature 1..22: note = Synthetic Construct
  source 1..22: mol_type = other DNA
gcacacagtgagccttggtttc

SEQ ID NO: 44085 - DNA, 20 bp, synthetic construct
  misc_feature 1..20: note = Synthetic Construct
  source 1..20: mol_type = other DNA
tggccttgcggagatgacaa

SEQ ID NO: 44086 - DNA, 26 bp, synthetic construct
  misc_feature 1..26: note = Synthetic Construct
  source 1..26: mol_type = other DNA
gggagacagacttacatgcttaattg

SEQ ID NO: 44087 - DNA, 21 bp, synthetic construct
  misc_feature 1..21: note = Synthetic Construct
  source 1..21: mol_type = other DNA
gccaggcacccagttgaagta

SEQ ID NO: 44088 - DNA, 19 bp, synthetic construct
  misc_feature 1..19: note = Synthetic Construct
  source 1..19: mol_type = other DNA
ggccgctcccaacaactca

SEQ ID NO: 44089 - DNA, 24 bp, synthetic construct
  misc_feature 1..24: note = Synthetic Construct
  source 1..24: mol_type = other DNA
ggaaagcccctgggtatggagata

SEQ ID NO: 44090 - DNA, 20 bp, synthetic construct
  misc_feature 1..20: note = Synthetic Construct
  source 1..20: mol_type = other DNA
tccggtcctccctgtccatt

SEQ ID NO: 44091 - DNA, 30 bp, synthetic construct
  misc_feature 1..30: note = Synthetic Construct
  source 1..30: mol_type = other DNA
gagatgactattcgttcccttattgccatt

SEQ ID NO: 44092 - DNA, 21 bp, synthetic construct
  misc_feature 1..21: note = Synthetic Construct
  source 1..21: mol_type = other DNA
tgacccttgtgggtggcagta

SEQ ID NO: 44093 - DNA, 29 bp, synthetic construct
  misc_feature 1..29: note = Synthetic Construct
  source 1..29: mol_type = other DNA
ggcttctgagaatgactttcacccttgat

SEQ ID NO: 44094 - DNA, 24 bp, synthetic construct
  misc_feature 1..24: note = Synthetic Construct
  source 1..24: mol_type = other DNA
gcccatgtagctttaggaaagtgt

SEQ ID NO: 44095 - DNA, 24 bp, synthetic construct
  misc_feature 1..24: note = Synthetic Construct
  source 1..24: mol_type = other DNA
acattcacagctttgatgcctaca

SEQ ID NO: 44096 - DNA, 22 bp, synthetic construct
  misc_feature 1..22: note = Synthetic Construct
  source 1..22: mol_type = other DNA
ggaggttgtgccaaagccactt

SEQ ID NO: 44097 - DNA, 20 bp, synthetic construct
  misc_feature 1..20: note = Synthetic Construct
  source 1..20: mol_type = other DNA
gaaaacgcacgggactcaga

SEQ ID NO: 44098 - DNA, 22 bp, synthetic construct
  misc_feature 1..22: note = Synthetic Construct
  source 1..22: mol_type = other DNA
ctgggcagtccatgactgattg

SEQ ID NO: 44099 - DNA, 24 bp, synthetic construct
  misc_feature 1..24: note = Synthetic Construct
  source 1..24: mol_type = other DNA
ggtcccaagatgtcagtcgcagtt

SEQ ID NO: 44100 - DNA, 23 bp, synthetic construct
  misc_feature 1..23: note = Synthetic Construct
  source 1..23: mol_type = other DNA
gagacagacatgacgggacttga

SEQ ID NO: 44101 - DNA, 23 bp, synthetic construct
  misc_feature 1..23: note = Synthetic Construct
  source 1..23: mol_type = other DNA
cagagctcaaagctcaggacttc

SEQ ID NO: 44102 - DNA, 22 bp, synthetic construct
  misc_feature 1..22: note = Synthetic Construct
  source 1..22: mol_type = other DNA
ccctgggagggttttgaaccaa

SEQ ID NO: 44103 - DNA, 23 bp, synthetic construct
  misc_feature 1..23: note = Synthetic Construct
  source 1..23: mol_type = other DNA
gaaaggcatggatatggcacaga

SEQ ID NO: 44104 - DNA, 24 bp, synthetic construct
  misc_feature 1..24: note = Synthetic Construct
  source 1..24: mol_type = other DNA
cagacgtagagcttgaggttcaca

SEQ ID NO: 44105 - DNA, 25 bp, synthetic construct
  misc_feature 1..25: note = Synthetic Construct
  source 1..25: mol_type = other DNA
gctacaggatacaatgaggttgtct

SEQ ID NO: 44106 - DNA, 23 bp, synthetic construct
  misc_feature 1..23: note = Synthetic Construct
  source 1..23: mol_type = other DNA
cccaggaatgccttccagcttag

SEQ ID NO: 44107 - DNA, 20 bp, synthetic construct
  misc_feature 1..20: note = Synthetic Construct
  source 1..20: mol_type = other DNA
atgtgccaggaacgatgtgt

SEQ ID NO: 44108 - DNA, 20 bp, synthetic construct
  misc_feature 1..20: note = Synthetic Construct
  source 1..20: mol_type = other DNA
ttggtgaacagtgccacctt

SEQ ID NO: 44109 - DNA, 21 bp, synthetic construct
  misc_feature 1..21: note = Synthetic Construct
  source 1..21: mol_type = other DNA
tggatctgtgcctgcctcaac

SEQ ID NO: 44110 - DNA, 20 bp, synthetic construct
  misc_feature 1..20: note = Synthetic Construct
  source 1..20: mol_type = other DNA
tccagagatggaggctgctt

SEQ ID NO: 44111 - DNA, 23 bp, synthetic construct
  misc_feature 1..23: note = Synthetic Construct
  source 1..23: mol_type = other DNA
tccctgtgtgtctcccagtgtag

SEQ ID NO: 44112 - DNA, 22 bp, synthetic construct
  misc_feature 1..22: note = Synthetic Construct
  source 1..22: mol_type = other DNA
cccatttgctgcactggtcttg

SEQ ID NO: 44113 - DNA, 25 bp, synthetic construct
  misc_feature 1..25: note = Synthetic Construct
  source 1..25: mol_type = other DNA
acttcatggagaagatggtgtttga

SEQ ID NO: 44114 - DNA, 20 bp, synthetic construct
  misc_feature 1..20: note = Synthetic Construct
  source 1..20: mol_type = other DNA
gccaaagcaaggccagatgt

SEQ ID NO: 44115 - DNA, 22 bp, synthetic construct
  misc_feature 1..22: note = Synthetic Construct
  source 1..22: mol_type = other DNA
gggccaaggaacccaatactga

SEQ ID NO: 44116 - DNA, 20 bp, synthetic construct
  misc_feature 1..20: note = Synthetic Construct
  source 1..20: mol_type = other DNA
aggctgtctctggcaactga

SEQ ID NO: 44117 - DNA, 22 bp, synthetic construct
  misc_feature 1..22: note = Synthetic Construct
  source 1..22: mol_type = other DNA
gtccccaggaatgtgacctttg

SEQ ID NO: 44118 - DNA, 25 bp, synthetic construct
  misc_feature 1..25: note = Synthetic Construct
  source 1..25: mol_type = other DNA
cctcagaatttcacagtgcctgttc

SEQ ID NO: 44119 - DNA, 21 bp, synthetic construct
  misc_feature 1..21: note = Synthetic Construct
  source 1..21: mol_type = other DNA
tggacctgctaagctccagaa

SEQ ID NO: 44120 - DNA, 21 bp, synthetic construct
  misc_feature 1..21: note = Synthetic Construct
  source 1..21: mol_type = other DNA
cgctcctttccaccccagatt

SEQ ID NO: 44121 - DNA, 22 bp, synthetic construct
  misc_feature 1..22: note = Synthetic Construct
  source 1..22: mol_type = other DNA
tttccctttgatggctccaact

SEQ ID NO: 44122 - DNA, 22 bp, synthetic construct
  misc_feature 1..22: note = Synthetic Construct
  source 1..22: mol_type = other DNA
ggagggaggtagaagggcaact

SEQ ID NO: 44123 - DNA, 18 bp, synthetic construct
  misc_feature 1..18: note = Synthetic Construct
  source 1..18: mol_type = other DNA
agcacctggaggcgctta

SEQ ID NO: 44124 - DNA, 20 bp, synthetic construct
  misc_feature 1..20: note = Synthetic Construct
  source 1..20: mol_type = other DNA
tgccgtggctgcttcttcaa

SEQ ID NO: 44125 - DNA, 26 bp, synthetic construct
  misc_feature 1..26: note = Synthetic Construct
  source 1..26: mol_type = other DNA
gcttacactctttcagactggatact

SEQ ID NO: 44126 - DNA, 22 bp, synthetic construct
  misc_feature 1..22: note = Synthetic Construct
  source 1..22: mol_type = other DNA
tggcacctacaccttcctgaac

SEQ ID NO: 44127 - DNA, 21 bp, synthetic construct
  misc_feature 1..21: note = Synthetic Construct
  source 1..21: mol_type = other DNA
ggcaccaaggccctccataat

SEQ ID NO: 44128 - DNA, 22 bp, synthetic construct
  misc_feature 1..22: note = Synthetic Construct
  source 1..22: mol_type = other DNA
tcttcctctcctaccccagact

SEQ ID NO: 44129 - DNA, 24 bp, synthetic construct
  misc_feature 1..24: note = Synthetic Construct
  source 1..24: mol_type = other DNA
atcatggaaggaagtgcttgatct

SEQ ID NO: 44130 - DNA, 20 bp, synthetic construct
  misc_feature 1..20: note = Synthetic Construct
  source 1..20: mol_type = other DNA
actccaccaaggcacagaca

SEQ ID NO: 44131 - DNA, 22 bp, synthetic construct
  misc_feature 1..22: note = Synthetic Construct
  source 1..22: mol_type = other DNA
tctctgacacagtggggtatca

SEQ ID NO: 44132 - DNA, 23 bp, synthetic construct
  misc_feature 1..23: note = Synthetic Construct
  source 1..23: mol_type = other DNA
cccacattagcagagaccactga

SEQ ID NO: 44133 - DNA, 24 bp, synthetic construct
  misc_feature 1..24: note = Synthetic Construct
  source 1..24: mol_type = other DNA
ggtgagagagcagcaagtgacctt

SEQ ID NO: 44134 - DNA, 24 bp, synthetic construct
  misc_feature 1..24: note = Synthetic Construct
  source 1..24: mol_type = other DNA
agggaaacttcattctgggttcat

SEQ ID NO: 44135 - DNA, 22 bp, synthetic construct
  misc_feature 1..22: note = Synthetic Construct
  source 1..22: mol_type = other DNA
tcgccccttcccacctttactt

SEQ ID NO: 44136 - DNA, 22 bp, synthetic construct
  misc_feature 1..22: note = Synthetic Construct
  source 1..22: mol_type = other DNA
ggtaggtcaggcagcaatcaag

SEQ ID NO: 44137 - DNA, 27 bp, synthetic construct
  misc_feature 1..27: note = Synthetic Construct
  source 1..27: mol_type = other DNA
ccttccacttacagcttagttcctgta

SEQ ID NO: 44138 - DNA, 21 bp, synthetic construct
  misc_feature 1..21: note = Synthetic Construct
  source 1..21: mol_type = other DNA
tcccgtacacctccctgctaa

SEQ ID NO: 44139 - DNA, 21 bp, synthetic construct
  misc_feature 1..21: note = Synthetic Construct
  source 1..21: mol_type = other DNA
tggctgtacccaggcatggaa

SEQ ID NO: 44140 - DNA, 23 bp, synthetic construct
  misc_feature 1..23: note = Synthetic Construct
  source 1..23: mol_type = other DNA
cagtgtgtccagccactaacttc

SEQ ID NO: 44141 - DNA, 22 bp, synthetic construct
  misc_feature 1..22: note = Synthetic Construct
  source 1..22: mol_type = other DNA
ggccacttgacctctcctgaaa

SEQ ID NO: 44142 - DNA, 25 bp, synthetic construct
  misc_feature 1..25: note = Synthetic Construct
  source 1..25: mol_type = other DNA
ggggaaaggtaagagtgagcatgaa

SEQ ID NO: 44143 - DNA, 19 bp, synthetic construct
  misc_feature 1..19: note = Synthetic Construct
  source 1..19: mol_type = other DNA
tgctgggccactgttgcat

SEQ ID NO: 44144 - DNA, 23 bp, synthetic construct
  misc_feature 1..23: note = Synthetic Construct
  source 1..23: mol_type = other DNA
gagccttctgactgaccttggta

SEQ ID NO: 44145 - DNA, 20 bp, synthetic construct
  misc_feature 1..20: note = Synthetic Construct
  source 1..20: mol_type = other DNA
gggcagtgctgaggtaaagt

SEQ ID NO: 44146 - DNA, 24 bp, synthetic construct
  misc_feature 1..24: note = Synthetic Construct
  source 1..24: mol_type = other DNA
gtggtggttagggaaatcgaggaa

SEQ ID NO: 44147 - DNA, 22 bp, synthetic construct
  misc_feature 1..22: note = Synthetic Construct
  source 1..22: mol_type = other DNA
cccatgaagcaggagtgaggaa

SEQ ID NO: 44148 - DNA, 22 bp, synthetic construct
  misc_feature 1..22: note = Synthetic Construct
  source 1..22: mol_type = other DNA
ggggaaggtagtgaagcaagtt

SEQ ID NO: 44149 - DNA, 20 bp, synthetic construct
  misc_feature 1..20: note = Synthetic Construct
  source 1..20: mol_type = other DNA
aagctcaccaggccctgact

SEQ ID NO: 44150 - DNA, 21 bp, synthetic construct
  misc_feature 1..21: note = Synthetic Construct
  source 1..21: mol_type = other DNA
tccttcacccctccacctgta

SEQ ID NO: 44151 - DNA, 22 bp, synthetic construct
  misc_feature 1..22: note = Synthetic Construct
  source 1..22: mol_type = other DNA
agcccttacagtggcctacaag

SEQ ID NO: 44152 - DNA, 21 bp, synthetic construct
  misc_feature 1..21: note = Synthetic Construct
  source 1..21: mol_type = other DNA
gtttggcagtgctgttgttca

SEQ ID NO: 44153 - DNA, 19 bp, synthetic construct
  misc_feature 1..19: note = Synthetic Construct
  source 1..19: mol_type = other DNA
tcaagggtgcctggtcagt

SEQ ID NO: 44154 - DNA, 22 bp, synthetic construct
  misc_feature 1..22: note = Synthetic Construct
  source 1..22: mol_type = other DNA
cggttcagccacaggttgtaag

SEQ ID NO: 44155 - DNA, 24 bp, synthetic construct
  misc_feature 1..24: note = Synthetic Construct
  source 1..24: mol_type = other DNA
acaaaggattgaggtgttgcctat

SEQ ID NO: 44156 - DNA, 26 bp, synthetic construct
  misc_feature 1..26: note = Synthetic Construct
  source 1..26: mol_type = other DNA
gcaggataaggctttcaaacgagctt

SEQ ID NO: 44157 - DNA, 23 bp, synthetic construct
  misc_feature 1..23: note = Synthetic Construct
  source 1..23: mol_type = other DNA
ccttcagatgcactcgacagttc

SEQ ID NO: 44158 - DNA, 21 bp, synthetic construct
  misc_feature 1..21: note = Synthetic Construct
  source 1..21: mol_type = other DNA
gccaaagcacccgtaccctaa

SEQ ID NO: 44159 - DNA, 25 bp, synthetic construct
  misc_feature 1..25: note = Synthetic Construct
  source 1..25: mol_type = other DNA
gcactggtggaactttcaaagcaat

SEQ ID NO: 44160 - DNA, 21 bp, synthetic construct
  misc_feature 1..21: note = Synthetic Construct
  source 1..21: mol_type = other DNA
agggcatggaagtgttccaaa

SEQ ID NO: 44161 - DNA, 22 bp, synthetic construct
  misc_feature 1..22: note = Synthetic Construct
  source 1..22: mol_type = other DNA
cacattccagtgctccacaaag

SEQ ID NO: 44162 - DNA, 28 bp, synthetic construct
  misc_feature 1..28: note = Synthetic Construct
  source 1..28: mol_type = other DNA
gtctcaattctgaacgagtcttcccttt

SEQ ID NO: 44163 - DNA, 20 bp, synthetic construct
  misc_feature 1..20: note = Synthetic Construct
  source 1..20: mol_type = other DNA
ggagcaaaagctcgccacaa

SEQ ID NO: 44164 - DNA, 24 bp, synthetic construct
  misc_feature 1..24: note = Synthetic Construct
  source 1..24: mol_type = other DNA
acttctgtgcgtaaagtcaaggaa

SEQ ID NO: 44165 - DNA, 22 bp, synthetic construct
  misc_feature 1..22: note = Synthetic Construct
  source 1..22: mol_type = other DNA
gtgaactgagtcggaccgaaag

SEQ ID NO: 44166 - DNA, 22 bp, synthetic construct
  misc_feature 1..22: note = Synthetic Construct
  source 1..22: mol_type = other DNA
gttaggctcctttgccccaaaa

SEQ ID NO: 44167 - DNA, 27 bp, synthetic construct
  misc_feature 1..27: note = Synthetic Construct
  source 1..27: mol_type = other DNA
gacaccttggctgatagaaaaatgcaa

SEQ ID NO: 44168 - DNA, 22 bp, synthetic construct
  misc_feature 1..22: note = Synthetic Construct
  source 1..22: mol_type = other DNA
ggggcagaacaatgctgacctt

SEQ ID NO: 44169 - DNA, 27 bp, synthetic construct
  misc_feature 1..27: note = Synthetic Construct
  source 1..27: mol_type = other DNA
gaggtgttattattgttgcagcgattg

SEQ ID NO: 44170 - DNA, 23 bp, synthetic construct
  misc_feature 1..23: note = Synthetic Construct
  source 1..23: mol_type = other DNA
ctgcctcaatctccccatgaaag

SEQ ID NO: 44171 - DNA, 22 bp, synthetic construct
  misc_feature 1..22: note = Synthetic Construct
  source 1..22: mol_type = other DNA
gtcaagagcacaccacttgctt

SEQ ID NO: 44172 - DNA, 22 bp, synthetic construct
  misc_feature 1..22: note = Synthetic Construct
  source 1..22: mol_type = other DNA
cagcaggtgacatctggagtag

SEQ ID NO: 44173 - DNA, 22 bp, synthetic construct
  misc_feature 1..22: note = Synthetic Construct
  source 1..22: mol_type = other DNA
ccctttggtaggtgcggagaaa

SEQ ID NO: 44174 - DNA, 24 bp, synthetic construct
  misc_feature 1..24: note = Synthetic Construct
  source 1..24: mol_type = other DNA
gggatcagaacccatggagacaac

SEQ ID NO: 44175 - DNA, 24 bp, synthetic construct
  misc_feature 1..24: note = Synthetic Construct
  source 1..24: mol_type = other DNA
acctcacctacaaacacacacttg

SEQ ID NO: 44176 - DNA, 22 bp, synthetic construct
  misc_feature 1..22: note = Synthetic Construct
  source 1..22: mol_type = other DNA
ccccagcttcacgcttctcaat

SEQ ID NO: 44177 - DNA, 24 bp, synthetic construct
  misc_feature 1..24: note = Synthetic Construct
  source 1..24: mol_type = other DNA
cctcatagtgccaggccttaggtt

SEQ ID NO: 44178 - DNA, 21 bp, synthetic construct
  misc_feature 1..21: note = Synthetic Construct
  source 1..21: mol_type = other DNA
aggcatcacctcctcgacaga

SEQ ID NO: 44179 - DNA, 22 bp, synthetic construct
  misc_feature 1..22: note = Synthetic Construct
  source 1..22: mol_type = other DNA
agactaggcactgttcctctga

SEQ ID NO: 44180 - DNA, 22 bp, synthetic construct
  misc_feature 1..22: note = Synthetic Construct
  source 1..22: mol_type = other DNA
aagtagttggccacctgtgaaa

SEQ ID NO: 44181 - DNA, 28 bp, synthetic construct
  misc_feature 1..28: note = Synthetic Construct
  source 1..28: mol_type = other DNA
ccatataaagtcagtcctctcaggcata

SEQ ID NO: 44182 - DNA, 23 bp, synthetic construct
  misc_feature 1..23: note = Synthetic Construct
  source 1..23: mol_type = other DNA
ctgtggtgagttggagggaaagt

SEQ ID NO: 44183 - DNA, 24 bp, synthetic construct
  misc_feature 1..24: note = Synthetic Construct
  source 1..24: mol_type = other DNA
ctcaaagtgaaccagcccaaatag

SEQ ID NO: 44184 - DNA, 21 bp, synthetic construct
  misc_feature 1..21: note = Synthetic Construct
  source 1..21: mol_type = other DNA
agccacaggctggtctctgtt

SEQ ID NO: 44185 - DNA, 24 bp, synthetic construct
  misc_feature 1..24: note = Synthetic Construct
  source 1..24: mol_type = other DNA
ggttgaagctgtgaggttggttag

SEQ ID NO: 44186 - DNA, 25 bp, synthetic construct
  misc_feature 1..25: note = Synthetic Construct
  source 1..25: mol_type = other DNA
aaaatgtacctggttggagtagctt

SEQ ID NO: 44187 - DNA, 22 bp, synthetic construct
  misc_feature 1..22: note = Synthetic Construct
  source 1..22: mol_type = other DNA
gtccttccagaagcctcagcat

SEQ ID NO: 44188 - DNA, 25 bp, synthetic construct
  misc_feature 1..25: note = Synthetic Construct
  source 1..25: mol_type = other DNA
gcctgtaggtgtcctaagaatgact

SEQ ID NO: 44189 - DNA, 26 bp, synthetic construct
  misc_feature 1..26: note = Synthetic Construct
  source 1..26: mol_type = other DNA
cattctaggcatgtgagagtaaggaa

SEQ ID NO: 44190 - DNA, 24 bp, synthetic construct
  misc_feature 1..24: note = Synthetic Construct
  source 1..24: mol_type = other DNA
gccagatccatatgctcctcaaag

SEQ ID NO: 44191 - DNA, 27 bp, synthetic construct
  misc_feature 1..27: note = Synthetic Construct
  source 1..27: mol_type = other DNA
gctgaccaccagacaattactgcattt

SEQ ID NO: 44192 - DNA, 20 bp, synthetic construct
  misc_feature 1..20: note = Synthetic Construct
  source 1..20: mol_type = other DNA
tgctgtactctggggctgta

SEQ ID NO: 44193 - DNA, 22 bp, synthetic construct
  misc_feature 1..22: note = Synthetic Construct
  source 1..22: mol_type = other DNA
tgctgtccccttcaggatagaa

SEQ ID NO: 44194 - DNA, 24 bp, synthetic construct
  misc_feature 1..24: note = Synthetic Construct
  source 1..24: mol_type = other DNA
cactcagtttcaagggcctaccta

SEQ ID NO: 44195 - DNA, 21 bp, synthetic construct
  misc_feature 1..21: note = Synthetic Construct
  source 1..21: mol_type = other DNA
taccacagcccatggcacaga

SEQ ID NO: 44196 - DNA, 24 bp, synthetic construct
  misc_feature 1..24: note = Synthetic Construct
  source 1..24: mol_type = other DNA
agccattattctggcattgagaca

SEQ ID NO: 44197 - DNA, 23 bp, synthetic construct
  misc_feature 1..23: note = Synthetic Construct
  source 1..23: mol_type = other DNA
gccagggagaccaaatcctttgt

SEQ ID NO: 44198 - DNA, 21 bp, synthetic construct
  misc_feature 1..21: note = Synthetic Construct
  source 1..21: mol_type = other DNA
gccagccatcaccaatgactt

SEQ ID NO: 44199 - DNA, 20 bp, synthetic construct
  misc_feature 1..20: note = Synthetic Construct
  source 1..20: mol_type = other DNA
cgctgtcagtggtgctactt

SEQ ID NO: 44200 - DNA, 24 bp, synthetic construct
  misc_feature 1..24: note = Synthetic Construct
  source 1..24: mol_type = other DNA
ggagagaattagccaaccctgtaa

SEQ ID NO: 44201 - DNA, 21 bp, synthetic construct
  misc_feature 1..21: note = Synthetic Construct
  source 1..21: mol_type = other DNA
accaagccatccagcctccat

SEQ ID NO: 44202 - DNA, 21 bp, synthetic construct
  misc_feature 1..21: note = Synthetic Construct
  source 1..21: mol_type = other DNA
tccaatgccacccagcaccta

SEQ ID NO: 44203 - DNA, 23 bp, synthetic construct
  misc_feature 1..23: note = Synthetic Construct
  source 1..23: mol_type = other DNA
gttgtgaccatttttgccacctt

SEQ ID NO: 44204 - DNA, 21 bp, synthetic construct
  misc_feature 1..21: note = Synthetic Construct
  source 1..21: mol_type = other DNA
cttcctccacaggctgtccta

SEQ ID NO: 44205 - DNA, 20 bp, synthetic construct
  misc_feature 1..20: note = Synthetic Construct
  source 1..20: mol_type = other DNA
ctgccctttgtggtggaagt

SEQ ID NO: 44206 - DNA, 22 bp, synthetic construct
  misc_feature 1..22: note = Synthetic Construct
  source 1..22: mol_type = other DNA
ccacaggccttagctccaatca

SEQ ID NO: 44207 - DNA, 21 bp, synthetic construct
  misc_feature 1..21: note = Synthetic Construct
  source 1..21: mol_type = other DNA
ccattcctatcgccccagttt

SEQ ID NO: 44208 - DNA, 25 bp, synthetic construct
  misc_feature 1..25: note = Synthetic Construct
  source 1..25: mol_type = other DNA
acttagcaagctatgaggctacttc

SEQ ID NO: 44209 - DNA, 25 bp, synthetic construct
  misc_feature 1..25: note = Synthetic Construct
  source 1..25: mol_type = other DNA
ccaggaactatgcatgattcagaac

SEQ ID NO: 44210 - DNA, 18 bp, synthetic construct
  misc_feature 1..18: note = Synthetic Construct
  source 1..18: mol_type = other DNA
acgtctggcgcgtgttgt

SEQ ID NO: 44211 - DNA, 23 bp, synthetic construct
  misc_feature 1..23: note = Synthetic Construct
  source 1..23: mol_type = other DNA
gcccagtcacacctttcaacttc

SEQ ID NO: 44212 - DNA, 27 bp, synthetic construct
  misc_feature 1..27: note = Synthetic Construct
  source 1..27: mol_type = other DNA
ggccaagatgagaaagtaggtggacat

SEQ ID NO: 44213 - DNA, 27 bp, synthetic construct
  misc_feature 1..27: note = Synthetic Construct
  source 1..27: mol_type = other DNA
tgacattctaaccctatttcccacttg

SEQ ID NO: 44214 - DNA, 23 bp, synthetic construct
  misc_feature 1..23: note = Synthetic Construct
  source 1..23: mol_type = other DNA
cagaaatgggtgcaaggaagcaa

SEQ ID NO: 44215 - DNA, 24 bp, synthetic construct
  misc_feature 1..24: note = Synthetic Construct
  source 1..24: mol_type = other DNA
cccagaaaatgtgagccatgaaga

SEQ ID NO: 44216 - DNA, 22 bp, synthetic construct
  misc_feature 1..22: note = Synthetic Construct
  source 1..22: mol_type = other DNA
cccaaggtggccattaaaggaa

SEQ ID NO: 44217 - DNA, 25 bp, synthetic construct
  misc_feature 1..25: note = Synthetic Construct
  source 1..25: mol_type = other DNA
gaccaccattattgctcctctgaac

SEQ ID NO: 44218 - DNA, 23 bp, synthetic construct
  misc_feature 1..23: note = Synthetic Construct
  source 1..23: mol_type = other DNA
ggtaccctggcagtactttctgt

SEQ ID NO: 44219 - DNA, 23 bp, synthetic construct
  misc_feature 1..23: note = Synthetic Construct
  source 1..23: mol_type = other DNA
attctccatgtgtcaaccgtctt

SEQ ID NO: 44220 - DNA, 27 bp, synthetic construct
  misc_feature 1..27: note = Synthetic Construct
  source 1..27: mol_type = other DNA
cagggataactgctcatgtaaggtact

SEQ ID NO: 44221 - DNA, 24 bp, synthetic construct
  misc_feature 1..24: note = Synthetic Construct
  source 1..24: mol_type = other DNA
cggaccaatgacagaaatggttag

SEQ ID NO: 44222 - DNA, 19 bp, synthetic construct
  misc_feature 1..19: note = Synthetic Construct
  source 1..19: mol_type = other DNA
ggacggctgggtttccttt

SEQ ID NO: 44223 - DNA, 21 bp, synthetic construct
  misc_feature 1..21: note = Synthetic Construct
  source 1..21: mol_type = other DNA
tggtcaatgggaatggcatgt

SEQ ID NO: 44224 - DNA, 24 bp, synthetic construct
  misc_feature 1..24: note = Synthetic Construct
  source 1..24: mol_type = other DNA
cctgaaactagtcacagcctctca

SEQ ID NO: 44225 - DNA, 23 bp, synthetic construct
  misc_feature 1..23: note = Synthetic Construct
  source 1..23: mol_type = other DNA
ggtaatggacagtgtcagcttct

SEQ ID NO: 44226 - DNA, 20 bp, synthetic construct
  misc_feature 1..20: note = Synthetic Construct
  source 1..20: mol_type = other DNA
acttctccagccacccaatg

SEQ ID NO: 44227 - DNA, 23 bp, synthetic construct
  misc_feature 1..23: note = Synthetic Construct
  source 1..23: mol_type = other DNA
tccagatagcccaaagaggtgaa

SEQ ID NO: 44228 - DNA, 21 bp, synthetic construct
  misc_feature 1..21: note = Synthetic Construct
  source 1..21: mol_type = other DNA
gccatagacagttggggtcaa

SEQ ID NO: 44229 - DNA, 22 bp, synthetic construct
  misc_feature 1..22: note = Synthetic Construct
  source 1..22: mol_type = other DNA
gcttatgggtggcttggagcat

SEQ ID NO: 44230 - DNA, 22 bp, synthetic construct
  misc_feature 1..22: note = Synthetic Construct
  source 1..22: mol_type = other DNA
ccaatcccctgctccttgacat

SEQ ID NO: 44231 - DNA, 21 bp, synthetic construct
  misc_feature 1..21: note = Synthetic Construct
  source 1..21: mol_type = other DNA
gtccatgccttagctgcaaga

SEQ ID NO: 44232 - DNA, 22 bp, synthetic construct
  misc_feature 1..22: note = Synthetic Construct
  source 1..22: mol_type = other DNA
ggtgagggcatggactttgtag

SEQ ID NO: 44233 - DNA, 21 bp, synthetic construct
  misc_feature 1..21: note = Synthetic Construct
  source 1..21: mol_type = other DNA
ttctggccacaccctcgctta

SEQ ID NO: 44234 - DNA, 21 bp, synthetic construct
  misc_feature 1..21: note = Synthetic Construct
  source 1..21: mol_type = other DNA
tgtgctaggtaggcccagtaa

SEQ ID NO: 44235 - DNA, 26 bp, synthetic construct
  misc_feature 1..26: note = Synthetic Construct
  source 1..26: mol_type = other DNA
ggggaggttttatcagtaccctttta

SEQ ID NO: 44236 - DNA, 25 bp, synthetic construct
  misc_feature 1..25: note = Synthetic Construct
  source 1..25: mol_type = other DNA
ggaaagacacagtggttcccaaatc

SEQ ID NO: 44237 - DNA, 25 bp, synthetic construct
  misc_feature 1..25: note = Synthetic Construct
  source 1..25: mol_type = other DNA
gtcttttaaacagttgcctcacaca

SEQ ID NO: 44238 - DNA, 23 bp, synthetic construct
  misc_feature 1..23: note = Synthetic Construct
  source 1..23: mol_type = other DNA
ctgtgagttccatcagggaagaa

SEQ ID NO: 44239 - DNA, 26 bp, synthetic construct
  misc_feature 1..26: note = Synthetic Construct
  source 1..26: mol_type = other DNA
ggatgatggggagagtcctgtgtatt

SEQ ID NO: 44240 - DNA, 24 bp, synthetic construct
  misc_feature 1..24: note = Synthetic Construct
  source 1..24: mol_type = other DNA
ggtctcttgaagacaggattccat

SEQ ID NO: 44241 - DNA, 22 bp, synthetic construct
  misc_feature 1..22: note = Synthetic Construct
  source 1..22: mol_type = other DNA
gcctgacacagacagagagcaa

SEQ ID NO: 44242 - DNA, 25 bp, synthetic construct
  misc_feature 1..25: note = Synthetic Construct
  source 1..25: mol_type = other DNA
tgtacttcaaactctgcatgtccaa

SEQ ID NO: 44243 - DNA, 22 bp, synthetic construct
  misc_feature 1..22: note = Synthetic Construct
  source 1..22: mol_type = other DNA
ctggagctagagcagtggcaat

SEQ ID NO: 44244 - DNA, 22 bp, synthetic construct
  misc_feature 1..22: note = Synthetic Construct
  source 1..22: mol_type = other DNA
gctgggttgctctccacaagaa

SEQ ID NO: 44245 - DNA, 25 bp, synthetic construct
  misc_feature 1..25: note = Synthetic Construct
  source 1..25: mol_type = other DNA
gccctacagaaaactttgggtctct

SEQ ID NO: 44246 - DNA, 22 bp, synthetic construct
  misc_feature 1..22: note = Synthetic Construct
  source 1..22: mol_type = other DNA
gccatcttggctcccaatgcaa

SEQ ID NO: 44247 - DNA, 25 bp, synthetic construct
  misc_feature 1..25: note = Synthetic Construct
  source 1..25: mol_type = other DNA
cctcactaaagtttgggtgcaggaa

SEQ ID NO: 44248 - DNA, 22 bp, synthetic construct
  misc_feature 1..22: note = Synthetic Construct
  source 1..22: mol_type = other DNA
ttccatgcaaagcaaggggtat

SEQ ID NO: 44249 - DNA, 21 bp, synthetic construct
  misc_feature 1..21: note = Synthetic Construct
  source 1..21: mol_type = other DNA
gcaagggaatccaggggcatt

SEQ ID NO: 44250 - DNA, 20 bp, synthetic construct
  misc_feature 1..20: note = Synthetic Construct
  source 1..20: mol_type = other DNA
accctgagtgagccagcaaa

SEQ ID NO: 44251 - DNA, 27 bp, synthetic construct
  misc_feature 1..27: note = Synthetic Construct
  source 1..27: mol_type = other DNA
aggaagcaaagagatcttaggatcaag

SEQ ID NO: 44252 - DNA, 22 bp, synthetic construct
  misc_feature 1..22: note = Synthetic Construct
  source 1..22: mol_type = other DNA
aacaggcccagtctcactatct

SEQ ID NO: 44253 - DNA, 24 bp, synthetic construct
  misc_feature 1..24: note = Synthetic Construct
  source 1..24: mol_type = other DNA
cccgagggaaaacaagagctggaa

SEQ ID NO: 44254 - DNA, 26 bp, synthetic construct
  misc_feature 1..26: note = Synthetic Construct
  source 1..26: mol_type = other DNA
ggcaggttaggtattagcaggaaatg

SEQ ID NO: 44255 - DNA, 20 bp, synthetic construct
  misc_feature 1..20: note = Synthetic Construct
  source 1..20: mol_type = other DNA
ggctgctggcctcatttact

SEQ ID NO: 44256 - DNA, 25 bp, synthetic construct
  misc_feature 1..25: note = Synthetic Construct
  source 1..25: mol_type = other DNA
gtcttgacagactagccttctgtag

SEQ ID NO: 44257 - DNA, 21 bp, synthetic construct
  misc_feature 1..21: note = Synthetic Construct
  source 1..21: mol_type = other DNA
tgtcagaaggaaggggtgact

SEQ ID NO: 44258 - DNA, 22 bp, synthetic construct
  misc_feature 1..22: note = Synthetic Construct
  source 1..22: mol_type = other DNA
gtgctgtgctaggtgcaaggta

SEQ ID NO: 44259 - DNA, 25 bp, synthetic construct
  misc_feature 1..25: note = Synthetic Construct
  source 1..25: mol_type = other DNA
acaaggtttatgtaacggccttgaa

SEQ ID NO: 44260 - DNA, 26 bp, synthetic construct
  misc_feature 1..26: note = Synthetic Construct
  source 1..26: mol_type = other DNA
gggaaaatctatgccatgaggacaca

SEQ ID NO: 44261 - DNA, 23 bp, synthetic construct
  misc_feature 1..23: note = Synthetic Construct
  source 1..23: mol_type = other DNA
tgagacacagggaggcccatatc

SEQ ID NO: 44262 - DNA, 24 bp, synthetic construct
  misc_feature 1..24: note = Synthetic Construct
  source 1..24: mol_type = other DNA
gggattgggattgttgccaagttc

SEQ ID NO: 44263 - DNA, 24 bp, synthetic construct
  misc_feature 1..24: note = Synthetic Construct
  source 1..24: mol_type = other DNA
gactagcatatggtggtggctact

SEQ ID NO: 44264 - DNA, 25 bp, synthetic construct
  misc_feature 1..25: note = Synthetic Construct
  source 1..25: mol_type = other DNA
ggtggggtacctagattcagaaaca

SEQ ID NO: 44265 - DNA, 23 bp, synthetic construct
  misc_feature 1..23: note = Synthetic Construct
  source 1..23: mol_type = other DNA
ccacaaactcccaggacatctct

SEQ ID NO: 44266 - DNA, 20 bp, synthetic construct
  misc_feature 1..20: note = Synthetic Construct
  source 1..20: mol_type = other DNA
taccaccgccgagaatggaa

SEQ ID NO: 44267 - DNA, 22 bp, synthetic construct
  misc_feature 1..22: note = Synthetic Construct
  source 1..22: mol_type = other DNA
agggtcccagtcaagcaggtaa

SEQ ID NO: 44268 - DNA, 23 bp, synthetic construct
  misc_feature 1..23: note = Synthetic Construct
  source 1..23: mol_type = other DNA
gccatggccacaaataggcagtt

SEQ ID NO: 44269 - DNA, 19 bp, synthetic construct
  misc_feature 1..19: note = Synthetic Construct
  source 1..19: mol_type = other DNA
gggcagaggggctttgaca

SEQ ID NO: 44270 - DNA, 20 bp, synthetic construct
  misc_feature 1..20: note = Synthetic Construct
  source 1..20: mol_type = other DNA
cagatgagggtgctgccttt

SEQ ID NO: 44271 - DNA, 24 bp, synthetic construct
  misc_feature 1..24: note = Synthetic Construct
  source 1..24: mol_type = other DNA
ggactccttccagcatctgtgaga

SEQ ID NO: 44272 - DNA, 25 bp, synthetic construct
  misc_feature 1..25: note = Synthetic Construct
  source 1..25: mol_type = other DNA
tgcccacatttaaaaggcatagagt

SEQ ID NO: 44273 - DNA, 20 bp, synthetic construct
  misc_feature 1..20: note = Synthetic Construct
  source 1..20: mol_type = other DNA
ctggtttggggaagcacagt

SEQ ID NO: 44274 - DNA, 22 bp, synthetic construct
  misc_feature 1..22: note = Synthetic Construct
  source 1..22: mol_type = other DNA
cctgctcgtgtttctgggatga

SEQ ID NO: 44275 - DNA, 23 bp, synthetic construct
  misc_feature 1..23: note = Synthetic Construct
  source 1..23: mol_type = other DNA
gggagaacagggtagggacattg

SEQ ID NO: 44276 - DNA, 19 bp, synthetic construct
  misc_feature 1..19: note = Synthetic Construct
  source 1..19: mol_type = other DNA
tggctggcagcgagagctt

SEQ ID NO: 44277 - DNA, 24 bp, synthetic construct
  misc_feature 1..24: note = Synthetic Construct
  source 1..24: mol_type = other DNA
ctgaggcagaaagtttgggtcagt

SEQ ID NO: 44278 - DNA, 24 bp, synthetic construct
  misc_feature 1..24: note = Synthetic Construct
  source 1..24: mol_type = other DNA
tgtcccagttttgacagaggaaac

SEQ ID NO: 44279 - DNA, 20 bp, synthetic construct
  misc_feature 1..20: note = Synthetic Construct
  source 1..20: mol_type = other DNA
ggggaatgtggaggggatga

SEQ ID NO: 44280 - DNA, 24 bp, synthetic construct
  misc_feature 1..24: note = Synthetic Construct
  source 1..24: mol_type = other DNA
gacagttgcttagggcagaagatt

SEQ ID NO: 44281 - DNA, 24 bp, synthetic construct
  misc_feature 1..24: note = Synthetic Construct
  source 1..24: mol_type = other DNA
ccccagataactatgggcttggat

SEQ ID NO: 44282 - DNA, 25 bp, synthetic construct
  misc_feature 1..25: note = Synthetic Construct
  source 1..25: mol_type = other DNA
caaggaaaacattcaggacttggtt

SEQ ID NO: 44283 - DNA, 21 bp, synthetic construct
  misc_feature 1..21: note = Synthetic Construct
  source 1..21: mol_type = other DNA
caacggaaacacaggggtcta

SEQ ID NO: 44284 - DNA, 26 bp, synthetic construct
  misc_feature 1..26: note = Synthetic Construct
  source 1..26: mol_type = other DNA
gagtttcaaggcttaacctgttcctt

SEQ ID NO: 44285 - DNA, 22 bp, synthetic construct
  misc_feature 1..22: note = Synthetic Construct
  source 1..22: mol_type = other DNA
gggtgagttgaaatgccacaaa

SEQ ID NO: 44286 - DNA, 24 bp, synthetic construct
  misc_feature 1..24: note = Synthetic Construct
  source 1..24: mol_type = other DNA
tcccattacaaaggctgtttcaga

SEQ ID NO: 44287 - DNA, 19 bp, synthetic construct
  misc_feature 1..19: note = Synthetic Construct
  source 1..19: mol_type = other DNA
agagggccctacccagtga

SEQ ID NO: 44288 - DNA, 20 bp, synthetic construct
  misc_feature 1..20: note = Synthetic Construct
  source 1..20: mol_type = other DNA
tgcgggccaagaatccagaa

SEQ ID NO: 44289 - DNA, 28 bp, synthetic construct
  misc_feature 1..28: note = Synthetic Construct
  source 1..28: mol_type = other DNA
ggactctacaagatcctgctgtagacat

SEQ ID NO: 44290 - DNA, 25 bp, synthetic construct
  misc_feature 1..25: note = Synthetic Construct
  source 1..25: mol_type = other DNA
ggagaagatttcacgggaagtcaaa

SEQ ID NO: 44291 - DNA, 22 bp, synthetic construct
  misc_feature 1..22: note = Synthetic Construct
  source 1..22: mol_type = other DNA
cttggttttgacctcccggaat

SEQ ID NO: 44292 - DNA, 22 bp, synthetic construct
  misc_feature 1..22: note = Synthetic Construct
  source 1..22: mol_type = other DNA
gagttgaggcttttgggtgtca

SEQ ID NO: 44293 - DNA, 26 bp, synthetic construct
  misc_feature 1..26: note = Synthetic Construct
  source 1..26: mol_type = other DNA
gtgattggttgcacgtagttgctaag

SEQ ID NO: 44294 - DNA, 24 bp, synthetic construct
  misc_feature 1..24: note = Synthetic Construct
  source 1..24: mol_type = other DNA
accaatgttccctttctgactgat

SEQ ID NO: 44295 - DNA, 19 bp, synthetic construct
  misc_feature 1..19: note = Synthetic Construct
  source 1..19: mol_type = other DNA
gcttccggctggccatctt

SEQ ID NO: 44296 - DNA, 22 bp, synthetic construct
  misc_feature 1..22: note = Synthetic Construct
  source 1..22: mol_type = other DNA
ctgttcacaaaccggagcacaa

SEQ ID NO: 44297 - DNA, 24 bp, synthetic construct
  misc_feature 1..24: note = Synthetic Construct
  source 1..24: mol_type = other DNA
cacaccatcgtatacacaccaaca

SEQ ID NO: 44298 - DNA, 22 bp, synthetic construct
  misc_feature 1..22: note = Synthetic Construct
  source 1..22: mol_type = other DNA
ggagagctgcattcgcttcatc

SEQ ID NO: 44299 - DNA, 25 bp, synthetic construct
  misc_feature 1..25: note = Synthetic Construct
  source 1..25: mol_type = other DNA
gccttgttcccagtcttaggaggaa

SEQ ID NO: 44300 - DNA, 21 bp, synthetic construct
  misc_feature 1..21: note = Synthetic Construct
  source 1..21: mol_type = other DNA
accctccatcagtggagcttt

SEQ ID NO: 44301 - DNA, 24 bp, synthetic construct
  misc_feature 1..24: note = Synthetic Construct
  source 1..24: mol_type = other DNA
ctttggttaatgcacagcatggaa

SEQ ID NO: 44302 - DNA, 23 bp, synthetic construct
  misc_feature 1..23: note = Synthetic Construct
  source 1..23: mol_type = other DNA
tgctgaggtcaaggcactaaaag

SEQ ID NO: 44303 - DNA, 20 bp, synthetic construct
  misc_feature 1..20: note = Synthetic Construct
  source 1..20: mol_type = other DNA
ggggaagcccactggaaaaa

SEQ ID NO: 44304 - DNA, 25 bp, synthetic construct
  misc_feature 1..25: note = Synthetic Construct
  source 1..25: mol_type = other DNA
cctgctgtatttgcttgccttgtag

SEQ ID NO: 44305 - DNA, 21 bp, synthetic construct
  misc_feature 1..21: note = Synthetic Construct
  source 1..21: mol_type = other DNA
ccacggagctcagagggtaag

SEQ ID NO: 44306 - DNA, 21 bp, synthetic construct
  misc_feature 1..21: note = Synthetic Construct
  source 1..21: mol_type = other DNA
ggccagtcacgctagagtctt

SEQ ID NO: 44307 - DNA, 21 bp, synthetic construct
  misc_feature 1..21: note = Synthetic Construct
  source 1..21: mol_type = other DNA
agagggtcacccagattggaa

SEQ ID NO: 44308 - DNA, 22 bp, synthetic construct
  misc_feature 1..22: note = Synthetic Construct
  source 1..22: mol_type = other DNA
aacaaacactgtgcctgctaga

SEQ ID NO: 44309 - DNA, 21 bp, synthetic construct
  misc_feature 1..21: note = Synthetic Construct
  source 1..21: mol_type = other DNA
cacacctcctgcacttcgttt

SEQ ID NO: 44310 - DNA, 20 bp, synthetic construct
  misc_feature 1..20: note = Synthetic Construct
  source 1..20: mol_type = other DNA
gcagaggtgatgcagccatt

SEQ ID NO: 44311 - DNA, 22 bp, synthetic construct
  misc_feature 1..22: note = Synthetic Construct
  source 1..22: mol_type = other DNA
gccctcaacgatctcgtctgtt

SEQ ID NO: 44312 - DNA, 28 bp, synthetic construct
  misc_feature 1..28: note = Synthetic Construct
  source 1..28: mol_type = other DNA
gcctgaggaaggggaagagtaatctatg

SEQ ID NO: 44313 - DNA, 20 bp, synthetic construct
  misc_feature 1..20: note = Synthetic Construct
  source 1..20: mol_type = other DNA
acagctgaccctgaccatgt

SEQ ID NO: 44314 - DNA, 22 bp, synthetic construct
  misc_feature 1..22: note = Synthetic Construct
  source 1..22: mol_type = other DNA
tggagagcatgggactccttca

SEQ ID NO: 44315 - DNA, 20 bp, synthetic construct
  misc_feature 1..20: note = Synthetic Construct
  source 1..20: mol_type = other DNA
agccagaaagcagcatgcaa

SEQ ID NO: 44316 - DNA, 26 bp, synthetic construct
  misc_feature 1..26: note = Synthetic Construct
  source 1..26: mol_type = other DNA
ctgagcccacttatggtgactaagat

SEQ ID NO: 44317 - DNA, 22 bp, synthetic construct
  misc_feature 1..22: note = Synthetic Construct
  source 1..22: mol_type = other DNA
cccacctcaacttgccagtctt

SEQ ID NO: 44318 - DNA, 19 bp, synthetic construct
  misc_feature 1..19: note = Synthetic Construct
  source 1..19: mol_type = other DNA
tcctgctggtcctctgcat

SEQ ID NO: 44319 - DNA, 21 bp, synthetic construct
  misc_feature 1..21: note = Synthetic Construct
  source 1..21: mol_type = other DNA
ccacagtgcctgtgtcacatc

SEQ ID NO: 44320 - DNA, 26 bp, synthetic construct
  misc_feature 1..26: note = Synthetic Construct
  source 1..26: mol_type = other DNA
gttttccccaattatcctccttcact

SEQ ID NO: 44321 - DNA, 25 bp, synthetic construct
  misc_feature 1..25: note = Synthetic Construct
  source 1..25: mol_type = other DNA
cccaggagttggagaaggtctcatt

SEQ ID NO: 44322 - DNA, 20 bp, synthetic construct
  misc_feature 1..20: note = Synthetic Construct
  source 1..20: mol_type = other DNA
tgcacgtctggagggatgat

SEQ ID NO: 44323 - DNA, 26 bp, synthetic construct
  misc_feature 1..26: note = Synthetic Construct
  source 1..26: mol_type = other DNA
ccaacctcactcaagccttattcagt

SEQ ID NO: 44324 - DNA, 30 bp, synthetic construct
  misc_feature 1..30: note = Synthetic Construct
  source 1..30: mol_type = other DNA
gggcagtttctaattgtcaatagccaggaa

SEQ ID NO: 44325 - DNA, 21 bp, synthetic construct
  misc_feature 1..21: note = Synthetic Construct
  source 1..21: mol_type = other DNA
gcctctctggcttcacagcaa

SEQ ID NO: 44326 - DNA, 22 bp, synthetic construct
  misc_feature 1..22: note = Synthetic Construct
  source 1..22: mol_type = other DNA
ctgctggtaaacctcccctagt

SEQ ID NO: 44327 - DNA, 24 bp, synthetic construct
  misc_feature 1..24: note = Synthetic Construct
  source 1..24: mol_type = other DNA
tgggaataaaagatctgggcttgt

SEQ ID NO: 44328 - DNA, 23 bp, synthetic construct
  misc_feature 1..23: note = Synthetic Construct
  source 1..23: mol_type = other DNA
ccggggcttggatttctcttgtt

SEQ ID NO: 44329 - DNA, 25 bp, synthetic construct
  misc_feature 1..25: note = Synthetic Construct
  source 1..25: mol_type = other DNA
ctgagcctttgatcctgtgtactgt

SEQ ID NO: 44330 - DNA, 19 bp, synthetic construct
  misc_feature 1..19: note = Synthetic Construct
  source 1..19: mol_type = other DNA
tccctgagctgggcactaa

SEQ ID NO: 44331 - DNA, 25 bp, synthetic construct
  misc_feature 1..25: note = Synthetic Construct
  source 1..25: mol_type = other DNA
caggctaactcaagacactcctaga

SEQ ID NO: 44332 - DNA, 25 bp, synthetic construct
  misc_feature 1..25: note = Synthetic Construct
  source 1..25: mol_type = other DNA
ctgtgaagaatgccaccaggatatt

SEQ ID NO: 44333 - DNA, 21 bp, synthetic construct
  misc_feature 1..21: note = Synthetic Construct
  source 1..21: mol_type = other DNA
cccaccatgacacagccctaa

SEQ ID NO: 44334 - DNA, 20 bp, synthetic construct
  misc_feature 1..20: note = Synthetic Construct
  source 1..20: mol_type = other DNA
catcaacgccaggccagaaa

SEQ ID NO: 44335 - DNA, 25 bp, synthetic construct
  misc_feature 1..25: note = Synthetic Construct
  source 1..25: mol_type = other DNA
ctttatatccaacccagacccaagt

SEQ ID NO: 44336 - DNA, 22 bp, synthetic construct
  misc_feature 1..22: note = Synthetic Construct
  source 1..22: mol_type = other DNA
gggtgggagagctggtctataa

SEQ ID NO: 44337 - DNA, 22 bp, synthetic construct
  misc_feature 1..22: note = Synthetic Construct
  source 1..22: mol_type = other DNA
ccctgccttgcctgtagcattt

SEQ ID NO: 44338 - DNA, 27 bp, synthetic construct
  misc_feature 1..27: note = Synthetic Construct
  source 1..27: mol_type = other DNA
gagtattgtgactaggtgggtaaatct

SEQ ID NO: 44339 - DNA, 23 bp, synthetic construct
  misc_feature 1..23: note = Synthetic Construct
  source 1..23: mol_type = other DNA
tgctaccaccctagtcaatgtca

SEQ ID NO: 44340 - DNA, 22 bp, synthetic construct
  misc_feature 1..22: note = Synthetic Construct
  source 1..22: mol_type = other DNA
ctgtgggacctttagcctgtct

SEQ ID NO: 44341 - DNA, 20 bp, synthetic construct
  misc_feature 1..20: note = Synthetic Construct
  source 1..20: mol_type = other DNA
tgccaacagtaggcctgaag

SEQ ID NO: 44342 - DNA, 23 bp, synthetic construct
  misc_feature 1..23: note = Synthetic Construct
  source 1..23: mol_type = other DNA
ggcttgaagggtttccactgaca

SEQ ID NO: 44343 - DNA, 20 bp, synthetic construct
  misc_feature 1..20: note = Synthetic Construct
  source 1..20: mol_type = other DNA
cgctgaagcttggggactct

SEQ ID NO: 44344 - DNA, 19 bp, synthetic construct
  misc_feature 1..19: note = Synthetic Construct
  source 1..19: mol_type = other DNA
aggctcctgggttgtcagt

SEQ ID NO: 44345 - DNA, 22 bp, synthetic construct
  misc_feature 1..22: note = Synthetic Construct
  source 1..22: mol_type = other DNA
ctctgcagcctcaaggtctcat

SEQ ID NO: 44346 - DNA, 20 bp, synthetic construct
  misc_feature 1..20: note = Synthetic Construct
  source 1..20: mol_type = other DNA
tgtcactgctgctggtccat

SEQ ID NO: 44347 - DNA, 24 bp, synthetic construct
  misc_feature 1..24: note = Synthetic Construct
  source 1..24: mol_type = other DNA
tgggaacatgtgcagaatcaaaga

SEQ ID NO: 44348 - DNA, 20 bp, synthetic construct
  misc_feature 1..20: note = Synthetic Construct
  source 1..20: mol_type = other DNA
gcagcaagttagccctgaga

SEQ ID NO: 44349 - DNA, 23 bp, synthetic construct
  misc_feature 1..23: note = Synthetic Construct
  source 1..23: mol_type = other DNA
gtagcaagtggtatgccttcctt

SEQ ID NO: 44350 - DNA, 22 bp, synthetic construct
  misc_feature 1..22: note = Synthetic Construct
  source 1..22: mol_type = other DNA
ccaagtccaagtgcccttcctt

SEQ ID NO: 44351 - DNA, 26 bp, synthetic construct
  misc_feature 1..26: note = Synthetic Construct
  source 1..26: mol_type = other DNA
ggaagcctcccacactagaataggta

SEQ ID NO: 44352 - DNA, 27 bp, synthetic construct
  misc_feature 1..27: note = Synthetic Construct
  source 1..27: mol_type = other DNA
gaggacaaatactatgcttcggagtaa

SEQ ID NO: 44353 - DNA, 22 bp, synthetic construct
  misc_feature 1..22: note = Synthetic Construct
  source 1..22: mol_type = other DNA
cctccccagcctcttttgacat

SEQ ID NO: 44354 - DNA, 20 bp, synthetic construct
  misc_feature 1..20: note = Synthetic Construct
  source 1..20: mol_type = other DNA
ggtttgctgctgcgctttgt

SEQ ID NO: 44355 - DNA, 21 bp, synthetic construct
  misc_feature 1..21: note = Synthetic Construct
  source 1..21: mol_type = other DNA
gcactgtgccagatgctatgt

SEQ ID NO: 44356 - DNA, 29 bp, synthetic construct
  misc_feature 1..29: note = Synthetic Construct
  source 1..29: mol_type = other DNA
cccagacaaaaatgatcaggcacaatact

SEQ ID NO: 44357 - DNA, 22 bp, synthetic construct
  misc_feature 1..22: note = Synthetic Construct
  source 1..22: mol_type = other DNA
ggaggtaggccaggtactatca

SEQ ID NO: 44358 - DNA, 24 bp, synthetic construct
  misc_feature 1..24: note = Synthetic Construct
  source 1..24: mol_type = other DNA
ggggtcagtcgtattttctgttgt

SEQ ID NO: 44359 - DNA, 21 bp, synthetic construct
  misc_feature 1..21: note = Synthetic Construct
  source 1..21: mol_type = other DNA
agtatcaggggccttccacaa

SEQ ID NO: 44360 - DNA, 23 bp, synthetic construct
  misc_feature 1..23: note = Synthetic Construct
  source 1..23: mol_type = other DNA
tctcctctgccctgtaagttttc

SEQ ID NO: 44361 - DNA, 23 bp, synthetic construct
  misc_feature 1..23: note = Synthetic Construct
  source 1..23: mol_type = other DNA
ccccaccataggagaaggtcttt

SEQ ID NO: 44362 - DNA, 22 bp, synthetic construct
  misc_feature 1..22: note = Synthetic Construct
  source 1..22: mol_type = other DNA
gcgctcggcaagactaggaata

SEQ ID NO: 44363 - DNA, 21 bp, synthetic construct
  misc_feature 1..21: note = Synthetic Construct
  source 1..21: mol_type = other DNA
aatggcacctttttgctgcat

SEQ ID NO: 44364 - DNA, 23 bp, synthetic construct
  misc_feature 1..23: note = Synthetic Construct
  source 1..23: mol_type = other DNA
ttgtccaggtaaagctgctcaat

SEQ ID NO: 44365 - DNA, 26 bp, synthetic construct
  misc_feature 1..26: note = Synthetic Construct
  source 1..26: mol_type = other DNA
ccaaaatctctcttggcacccatgtt

SEQ ID NO: 44366 - DNA, 25 bp, synthetic construct
  misc_feature 1..25: note = Synthetic Construct
  source 1..25: mol_type = other DNA
gccgatccgtctatcaacctgtttc

SEQ ID NO: 44367 - DNA, 24 bp, synthetic construct
  misc_feature 1..24: note = Synthetic Construct
  source 1..24: mol_type = other DNA
caagcaattcttcaccaacacctt

SEQ ID NO: 44368 - DNA, 22 bp, synthetic construct
  misc_feature 1..22: note = Synthetic Construct
  source 1..22: mol_type = other DNA
ccctggtgcatggatcacagtt

SEQ ID NO: 44369 - DNA, 24 bp, synthetic construct
  misc_feature 1..24: note = Synthetic Construct
  source 1..24: mol_type = other DNA
cagttgcaaccatgtttcctctca

SEQ ID NO: 44370 - DNA, 22 bp, synthetic construct
  misc_feature 1..22: note = Synthetic Construct
  source 1..22: mol_type = other DNA
gaaggaacctgtctggtgatgt

SEQ ID NO: 44371 - DNA, 25 bp, synthetic construct
  misc_feature 1..25: note = Synthetic Construct
  source 1..25: mol_type = other DNA
cccaaggtaaaagcaattcttgtgt

SEQ ID NO: 44372 - DNA, 22 bp, synthetic construct
  misc_feature 1..22: note = Synthetic Construct
  source 1..22: mol_type = other DNA
actgggcttcaaagacccaaag

SEQ ID NO: 44373 - DNA, 23 bp, synthetic construct
  misc_feature 1..23: note = Synthetic Construct
  source 1..23: mol_type = other DNA
aaggagaactgactctcccagat

SEQ ID NO: 44374 - DNA, 22 bp, synthetic construct
  misc_feature 1..22: note = Synthetic Construct
  source 1..22: mol_type = other DNA
ggctcgtcagtctcttctctgt

SEQ ID NO: 44375 - DNA, 20 bp, synthetic construct
  misc_feature 1..20: note = Synthetic Construct
  source 1..20: mol_type = other DNA
ccactgtgcctggcctcaat

SEQ ID NO: 44376 - DNA, 25 bp, synthetic construct
  misc_feature 1..25: note = Synthetic Construct
  source 1..25: mol_type = other DNA
ggttcttggtatggaatcctagtgt

SEQ ID NO: 44377 - DNA, 24 bp, synthetic construct
  misc_feature 1..24: note = Synthetic Construct
  source 1..24: mol_type = other DNA
cccataagtggatttcctgtgaga

SEQ ID NO: 44378 - DNA, 22 bp, synthetic construct
  misc_feature 1..22: note = Synthetic Construct
  source 1..22: mol_type = other DNA
acaaacagcaatgctccagcta

SEQ ID NO: 44379 - DNA, 24 bp, synthetic construct
  misc_feature 1..24: note = Synthetic Construct
  source 1..24: mol_type = other DNA
gccctttgaaataaggcagagtca

SEQ ID NO: 44380 - DNA, 21 bp, synthetic construct
  misc_feature 1..21: note = Synthetic Construct
  source 1..21: mol_type = other DNA
tccataggcttgctggactca

SEQ ID NO: 44381 - DNA, 20 bp, synthetic construct
  misc_feature 1..20: note = Synthetic Construct
  source 1..20: mol_type = other DNA
gacaccacacacctgcgaaa

SEQ ID NO: 44382 - DNA, 24 bp, synthetic construct
  misc_feature 1..24: note = Synthetic Construct
  source 1..24: mol_type = other DNA
aggtcacactctagacctgtcatt

SEQ ID NO: 44383 - DNA, 22 bp, synthetic construct
  misc_feature 1..22: note = Synthetic Construct
  source 1..22: mol_type = other DNA
gggttggcttggcatcctttga

SEQ ID NO: 44384 - DNA, 20 bp, synthetic construct
  misc_feature 1..20: note = Synthetic Construct
  source 1..20: mol_type = other DNA
agcagctttgtggcctggta

SEQ ID NO: 44385 - DNA, 27 bp, synthetic construct
  misc_feature 1..27: note = Synthetic Construct
  source 1..27: mol_type = other DNA
gaaatacagtggaaccacaatgaccta

SEQ ID NO: 44386 - DNA, 22 bp, synthetic construct
  misc_feature 1..22: note = Synthetic Construct
  source 1..22: mol_type = other DNA
ggcacgaatcattccagcttca

SEQ ID NO: 44387 - DNA, 23 bp, synthetic construct
  misc_feature 1..23: note = Synthetic Construct
  source 1..23: mol_type = other DNA
ggcagctgcactacaaagtgtct

SEQ ID NO: 44388 - DNA, 26 bp, synthetic construct
  misc_feature 1..26: note = Synthetic Construct
  source 1..26: mol_type = other DNA
gagtctgtatctgaaagtaccccatt

SEQ ID NO: 44389 - DNA, 23 bp, synthetic construct
  misc_feature 1..23: note = Synthetic Construct
  source 1..23: mol_type = other DNA
ggaccccatcctgtggtcatttc

SEQ ID NO: 44390 - DNA, 24 bp, synthetic construct
  misc_feature 1..24: note = Synthetic Construct
  source 1..24: mol_type = other DNA
cctccctgtagctttgaggtggtt

SEQ ID NO: 44391 - DNA, 23 bp, synthetic construct
  misc_feature 1..23: note = Synthetic Construct
  source 1..23: mol_type = other DNA
gctaagagaagccgtttggcata

SEQ ID NO: 44392 - DNA, 20 bp, synthetic construct
  misc_feature 1..20: note = Synthetic Construct
  source 1..20: mol_type = other DNA
agggaggtgccatgagttga

SEQ ID NO: 44393 - DNA, 23 bp, synthetic construct
  misc_feature 1..23: note = Synthetic Construct
  source 1..23: mol_type = other DNA
gccctgaataactggcagcaatg

SEQ ID NO: 44394 - DNA, 22 bp, synthetic construct
  misc_feature 1..22: note = Synthetic Construct
  source 1..22: mol_type = other DNA
gctgaactcccgctttccttgt

SEQ ID NO: 44395 - DNA, 23 bp, synthetic construct
  misc_feature 1..23: note = Synthetic Construct
  source 1..23: mol_type = other DNA
ggacttcattggtcctgggtgta

SEQ ID NO: 44396 - DNA, 20 bp, synthetic construct
  misc_feature 1..20: note = Synthetic Construct
  source 1..20: mol_type = other DNA
actctgcaggaggcacaaac

SEQ ID NO: 44397 - DNA, 25 bp, synthetic construct
  misc_feature 1..25: note = Synthetic Construct
  source 1..25: mol_type = other DNA
acttactgtgtacttgtgcttggat

SEQ ID NO: 44398 - DNA, 25 bp, synthetic construct
  misc_feature 1..25: note = Synthetic Construct
  source 1..25: mol_type = other DNA
ggtgaccctcttgggagttaagagt

SEQ ID NO: 44399 - DNA, 22 bp, synthetic construct
  misc_feature 1..22: note = Synthetic Construct
  source 1..22: mol_type = other DNA
gtggaaatacccagagcacaca

SEQ ID NO: 44400 - DNA, 24 bp, synthetic construct
  misc_feature 1..24: note = Synthetic Construct
  source 1..24: mol_type = other DNA
gcagcacgtatatctcaccgatgt

SEQ ID NO: 44401 - DNA, 23 bp, synthetic construct
  misc_feature 1..23: note = Synthetic Construct
  source 1..23: mol_type = other DNA
ggcagggctaatttgacacaatg

SEQ ID NO: 44402 - DNA, 25 bp, synthetic construct
  misc_feature 1..25: note = Synthetic Construct
  source 1..25: mol_type = other DNA
gaggaaaaaggtacagagtgagtga

SEQ ID NO: 44403 - DNA, 20 bp, synthetic construct
  misc_feature 1..20: note = Synthetic Construct
  source 1..20: mol_type = other DNA
acacaacgtcctgcccaaag

SEQ ID NO: 44404 - DNA, 20 bp, synthetic construct
  misc_feature 1..20: note = Synthetic Construct
  source 1..20: mol_type = other DNA
ttcctccagaggcctgagtt

SEQ ID NO: 44405 - DNA, 19 bp, synthetic construct
  misc_feature 1..19: note = Synthetic Construct
  source 1..19: mol_type = other DNA
cctgtgggcccagacttca

SEQ ID NO: 44406 - DNA, 20 bp, synthetic construct
  misc_feature 1..20: note = Synthetic Construct
  source 1..20: mol_type = other DNA
agccagctgccattttgaga

SEQ ID NO: 44407 - DNA, 22 bp, synthetic construct
  misc_feature 1..22: note = Synthetic Construct
  source 1..22: mol_type = other DNA
cctgaaagcccacccacacaat

SEQ ID NO: 44408 - DNA, 25 bp, synthetic construct
  misc_feature 1..25: note = Synthetic Construct
  source 1..25: mol_type = other DNA
gggtagttcaagggacttctgtttc

SEQ ID NO: 44409 - DNA, 23 bp, synthetic construct
  misc_feature 1..23: note = Synthetic Construct
  source 1..23: mol_type = other DNA
gcttcagcagtggctaagaatga

SEQ ID NO: 44410 - DNA, 24 bp, synthetic construct
  misc_feature 1..24: note = Synthetic Construct
  source 1..24: mol_type = other DNA
ggtcgctgtctcatagggtctgta

SEQ ID NO: 44411 - DNA, 22 bp, synthetic construct
  misc_feature 1..22: note = Synthetic Construct
  source 1..22: mol_type = other DNA
gggagctatgcaggatgcactt

SEQ ID NO: 44412 - DNA, 20 bp, synthetic construct
  misc_feature 1..20: note = Synthetic Construct
  source 1..20: mol_type = other DNA
agcccacccactctcactta

SEQ ID NO: 44413 - DNA, 23 bp, synthetic construct
  misc_feature 1..23: note = Synthetic Construct
  source 1..23: mol_type = other DNA
cgccttgaagttagatgcactgt

SEQ ID NO: 44414 - DNA, 20 bp, synthetic construct
  misc_feature 1..20: note = Synthetic Construct
  source 1..20: mol_type = other DNA
aactgctatgcgggcagtga

SEQ ID NO: 44415 - DNA, 26 bp, synthetic construct
  misc_feature 1..26: note = Synthetic Construct
  source 1..26: mol_type = other DNA
gcagctagagaggtgagggtgaaatc

SEQ ID NO: 44416 - DNA, 28 bp, synthetic construct
  misc_feature 1..28: note = Synthetic Construct
  source 1..28: mol_type = other DNA
cccttgttccttatctcacagacccaaa

SEQ ID NO: 44417 - DNA, 21 bp, synthetic construct
  misc_feature 1..21: note = Synthetic Construct
  source 1..21: mol_type = other DNA
tccccaattgacctcctggat

SEQ ID NO: 44418 - DNA, 19 bp, synthetic construct
  misc_feature 1..19: note = Synthetic Construct
  source 1..19: mol_type = other DNA
gtggcatgggaggggtagt

SEQ ID NO: 44419 - DNA, 24 bp, synthetic construct
  misc_feature 1..24: note = Synthetic Construct
  source 1..24: mol_type = other DNA
gcatctgggaaagaagtggtggtt

SEQ ID NO: 44420 - DNA, 22 bp, synthetic construct
  misc_feature 1..22: note = Synthetic Construct
  source 1..22: mol_type = other DNA
atgtcagaggtctccacagcta

SEQ ID NO: 44421 - DNA, 22 bp, synthetic construct
  misc_feature 1..22: note = Synthetic Construct
  source 1..22: mol_type = other DNA
acctaacagagctggacagttg

SEQ ID NO: 44422 - DNA, 19 bp, synthetic construct
  misc_feature 1..19: note = Synthetic Construct
  source 1..19: mol_type = other DNA
agagcttggggcagactga

SEQ ID NO: 44423 - DNA, 22 bp, synthetic construct
  misc_feature 1..22: note = Synthetic Construct
  source 1..22: mol_type = other DNA
cccaccttgccacatgacaaca

SEQ ID NO: 44424 - DNA, 20 bp, synthetic construct
  misc_feature 1..20: note = Synthetic Construct
  source 1..20: mol_type = other DNA
tgtaacgtgggtccctgact

SEQ ID NO: 44425 - DNA, 22 bp, synthetic construct
  misc_feature 1..22: note = Synthetic Construct
  source 1..22: mol_type = other DNA
cctggtttgggtcacctggttt

SEQ ID NO: 44426 - DNA, 23 bp, synthetic construct
  misc_feature 1..23: note = Synthetic Construct
  source 1..23: mol_type = other DNA
caccaaacctagcatggaacaca

SEQ ID NO: 44427 - DNA, 24 bp, synthetic construct
  misc_feature 1..24: note = Synthetic Construct
  source 1..24: mol_type = other DNA
ccaaggctaacaattccgctcttc

SEQ ID NO: 44428 - DNA, 22 bp, synthetic construct
  misc_feature 1..22: note = Synthetic Construct
  source 1..22: mol_type = other DNA
agggccttgatggtccttgtag

SEQ ID NO: 44429 - DNA, 27 bp, synthetic construct
  misc_feature 1..27: note = Synthetic Construct
  source 1..27: mol_type = other DNA
ggtttatttaaagccccagaggacttc

SEQ ID NO: 44430 - DNA, 27 bp, synthetic construct
  misc_feature 1..27: note = Synthetic Construct
  source 1..27: mol_type = other DNA
gtatagtattgtacctggccctcatag

SEQ ID NO: 44431 - DNA, 19 bp, synthetic construct
  misc_feature 1..19: note = Synthetic Construct
  source 1..19: mol_type = other DNA
taggtggctggctgcgtat

SEQ ID NO: 44432 - DNA, 21 bp, synthetic construct
  misc_feature 1..21: note = Synthetic Construct
  source 1..21: mol_type = other DNA
aggggcttggatcctggcaaa

SEQ ID NO: 44433 - DNA, 22 bp, synthetic construct
  misc_feature 1..22: note = Synthetic Construct
  source 1..22: mol_type = other DNA
cggagatctctggggcacaaaa

SEQ ID NO: 44434 - DNA, 27 bp, synthetic construct
  misc_feature 1..27: note = Synthetic Construct
  source 1..27: mol_type = other DNA
cacaaagatgccttatggatggagttc

SEQ ID NO: 44435 - DNA, 18 bp, synthetic construct
  misc_feature 1..18: note = Synthetic Construct
  source 1..18: mol_type = other DNA
acacgccccggtttttca

SEQ ID NO: 44436 - DNA, 20 bp, synthetic construct
  misc_feature 1..20: note = Synthetic Construct
  source 1..20: mol_type = other DNA
acaagccagagacccagaca

SEQ ID NO: 44437 - DNA, 24 bp, synthetic construct
  misc_feature 1..24: note = Synthetic Construct
  source 1..24: mol_type = other DNA
ggcaacctttgacagcctcaaaat

SEQ ID NO: 44438 - DNA, 19 bp, synthetic construct
  misc_feature 1..19: note = Synthetic Construct
  source 1..19: mol_type = other DNA
aactgagtgcgtgctccaa

SEQ ID NO: 44439 - DNA, 20 bp, synthetic construct
  misc_feature 1..20: note = Synthetic Construct
  source 1..20: mol_type = other DNA
cctgagcacgtgtgcaatct

SEQ ID NO: 44440 - DNA, 22 bp, synthetic construct
  misc_feature 1..22: note = Synthetic Construct
  source 1..22: mol_type = other DNA
gcttcccaagcatgggttcaag

SEQ ID NO: 44441 - DNA, 21 bp, synthetic construct
  misc_feature 1..21: note = Synthetic Construct
  source 1..21: mol_type = other DNA
gcccctggttcctgtttgttt

SEQ ID NO: 44442 - DNA, 24 bp, synthetic construct
  misc_feature 1..24: note = Synthetic Construct
  source 1..24: mol_type = other DNA
accaattcggtacagtgagtttct

SEQ ID NO: 44443 - DNA, 21 bp, synthetic construct
  misc_feature 1..21: note = Synthetic Construct
  source 1..21: mol_type = other DNA
tggccacagcagcactaattc

SEQ ID NO: 44444 - DNA, 25 bp, synthetic construct
  misc_feature 1..25: note = Synthetic Construct
  source 1..25: mol_type = other DNA
gactgacttagtccagggaaagcat

SEQ ID NO: 44445 - DNA, 24 bp, synthetic construct
  misc_feature 1..24: note = Synthetic Construct
  source 1..24: mol_type = other DNA
gacttttcaaaacccatcccacaa

SEQ ID NO: 44446 - DNA, 22 bp, synthetic construct
  misc_feature 1..22: note = Synthetic Construct
  source 1..22: mol_type = other DNA
gacttttccgactgtccagctt

SEQ ID NO: 44447 - DNA, 22 bp, synthetic construct
  misc_feature 1..22: note = Synthetic Construct
  source 1..22: mol_type = other DNA
gtcacgcttggagcatcttttc

SEQ ID NO: 44448 - DNA, 20 bp, synthetic construct
  misc_feature 1..20: note = Synthetic Construct
  source 1..20: mol_type = other DNA
gcaacctgacagcagctcta

SEQ ID NO: 44449 - DNA, 23 bp, synthetic construct
  misc_feature 1..23: note = Synthetic Construct
  source 1..23: mol_type = other DNA
aaaagcaagacccaactgtgttc

SEQ ID NO: 44450 - DNA, 22 bp, synthetic construct
  misc_feature 1..22: note = Synthetic Construct
  source 1..22: mol_type = other DNA
ctgcagtgggtagctcctttct

SEQ ID NO: 44451 - DNA, 20 bp, synthetic construct
  misc_feature 1..20: note = Synthetic Construct
  source 1..20: mol_type = other DNA
tccccttggagtagcaggtt

SEQ ID NO: 44452 - DNA, 28 bp, synthetic construct
  misc_feature 1..28: note = Synthetic Construct
  source 1..28: mol_type = other DNA
cacctctaatagaagactggaacaggta

SEQ ID NO: 44453 - DNA, 21 bp, synthetic construct
  misc_feature 1..21: note = Synthetic Construct
  source 1..21: mol_type = other DNA
gtcaggactgcaacacactct

SEQ ID NO: 44454 - DNA, 19 bp, synthetic construct
  misc_feature 1..19: note = Synthetic Construct
  source 1..19: mol_type = other DNA
tcaggctgccacagtcagt

SEQ ID NO: 44455 - DNA, 28 bp, synthetic construct
  misc_feature 1..28: note = Synthetic Construct
  source 1..28: mol_type = other DNA
ggtactatttctctcatagccaggattc

SEQ ID NO: 44456 - DNA, 23 bp, synthetic construct
  misc_feature 1..23: note = Synthetic Construct
  source 1..23: mol_type = other DNA
ctgctatgacagtgcaggattga

SEQ ID NO: 44457 - DNA, 26 bp, synthetic construct
  misc_feature 1..26: note = Synthetic Construct
  source 1..26: mol_type = other DNA
gggttagttttcatgcagcaggtatg

SEQ ID NO: 44458 - DNA, 30 bp, synthetic construct
  misc_feature 1..30: note = Synthetic Construct
  source 1..30: mol_type = other DNA
gtctgccaattaagacaaatggctttgcat

SEQ ID NO: 44459 - DNA, 25 bp, synthetic construct
  misc_feature 1..25: note = Synthetic Construct
  source 1..25: mol_type = other DNA
ggcagaaaaacaccaacgggaaatc

SEQ ID NO: 44460 - DNA, 19 bp, synthetic construct
  misc_feature 1..19: note = Synthetic Construct
  source 1..19: mol_type = other DNA
tctcgctccaggcttgctt

SEQ ID NO: 44461 - DNA, 27 bp, synthetic construct
  misc_feature 1..27: note = Synthetic Construct
  source 1..27: mol_type = other DNA
cactcaaagtagcttggaaaggcagta

SEQ ID NO: 44462 - DNA, 24 bp, synthetic construct
  misc_feature 1..24: note = Synthetic Construct
  source 1..24: mol_type = other DNA
gcgtaagtccaatggccatgaaag

SEQ ID NO: 44463 - DNA, 22 bp, synthetic construct
  misc_feature 1..22: note = Synthetic Construct
  source 1..22: mol_type = other DNA
ccctagtttgggccgtgtgttt

SEQ ID NO: 44464 - DNA, 25 bp, synthetic construct
  misc_feature 1..25: note = Synthetic Construct
  source 1..25: mol_type = other DNA
ggggtgagtaagggacttattgtag

SEQ ID NO: 44465 - DNA, 21 bp, synthetic construct
  misc_feature 1..21: note = Synthetic Construct
  source 1..21: mol_type = other DNA
ataggcccagtggccaggata

SEQ ID NO: 44466 - DNA, 24 bp, synthetic construct
  misc_feature 1..24: note = Synthetic Construct
  source 1..24: mol_type = other DNA
gtgcagcaagaatgtgatgaggaa

SEQ ID NO: 44467 - DNA, 24 bp, synthetic construct
  misc_feature 1..24: note = Synthetic Construct
  source 1..24: mol_type = other DNA
gagggttggttggaagggattaag

SEQ ID NO: 44468 - DNA, 22 bp, synthetic construct
  misc_feature 1..22: note = Synthetic Construct
  source 1..22: mol_type = other DNA
ggcttctcctacatggcagaca

SEQ ID NO: 44469 - DNA, 23 bp, synthetic construct
  misc_feature 1..23: note = Synthetic Construct
  source 1..23: mol_type = other DNA
ggtctccagatctccctcagcta

SEQ ID NO: 44470 - DNA, 21 bp, synthetic construct
  misc_feature 1..21: note = Synthetic Construct
  source 1..21: mol_type = other DNA
tgccaaactggccctccaaag

SEQ ID NO: 44471 - DNA, 18 bp, synthetic construct
  misc_feature 1..18: note = Synthetic Construct
  source 1..18: mol_type = other DNA
gttgccagccagcaccat

SEQ ID NO: 44472 - DNA, 27 bp, synthetic construct
  misc_feature 1..27: note = Synthetic Construct
  source 1..27: mol_type = other DNA
gctgatgaagtcatggaatcctcttct

SEQ ID NO: 44473 - DNA, 22 bp, synthetic construct
  misc_feature 1..22: note = Synthetic Construct
  source 1..22: mol_type = other DNA
gcttgcaccacaactccaccaa

SEQ ID NO: 44474 - DNA, 26 bp, synthetic construct
  misc_feature 1..26: note = Synthetic Construct
  source 1..26: mol_type = other DNA
gtagttttgttagaaccgtggtcttc

SEQ ID NO: 44475 - DNA, 27 bp, synthetic construct
  misc_feature 1..27: note = Synthetic Construct
  source 1..27: mol_type = other DNA
ggtggtctgaatattaagcaagagttg

SEQ ID NO: 44476 - DNA, 20 bp, synthetic construct
  misc_feature 1..20: note = Synthetic Construct
  source 1..20: mol_type = other DNA
cccacagtgccccactaaca

SEQ ID NO: 44477 - DNA, 22 bp, synthetic construct
  misc_feature 1..22: note = Synthetic Construct
  source 1..22: mol_type = other DNA
ggccttttgactccttggcttt

SEQ ID NO: 44478 - DNA, 19 bp, synthetic construct
  misc_feature 1..19: note = Synthetic Construct
  source 1..19: mol_type = other DNA
ctggccagccgtgcataat

SEQ ID NO: 44479 - DNA, 22 bp, synthetic construct
  misc_feature 1..22: note = Synthetic Construct
  source 1..22: mol_type = other DNA
ccttctgccctcctgtatctca

SEQ ID NO: 44480 - DNA, 22 bp, synthetic construct
  misc_feature 1..22: note = Synthetic Construct
  source 1..22: mol_type = other DNA
cgacatccttcaccatgccatt

SEQ ID NO: 44481 - DNA, 22 bp, synthetic construct
  misc_feature 1..22: note = Synthetic Construct
  source 1..22: mol_type = other DNA
tgaagcagacatgaagctcact

SEQ ID NO: 44482 - DNA, 24 bp, synthetic construct
  misc_feature 1..24: note = Synthetic Construct
  source 1..24: mol_type = other DNA
acacatacgcacagctaacatact

SEQ ID NO: 44483 - DNA, 22 bp, synthetic construct
  misc_feature 1..22: note = Synthetic Construct
  source 1..22: mol_type = other DNA
gtactgaccttgcagagccttt

SEQ ID NO: 44484 - DNA, 22 bp, synthetic construct
  misc_feature 1..22: note = Synthetic Construct
  source 1..22: mol_type = other DNA
gctggaggtgttgtggtgaatc

SEQ ID NO: 44485 - DNA, 21 bp, synthetic construct
  misc_feature 1..21: note = Synthetic Construct
  source 1..21: mol_type = other DNA
ccctggctttgggttggtgat

SEQ ID NO: 44486 - DNA, 23 bp, synthetic construct
  misc_feature 1..23: note = Synthetic Construct
  source 1..23: mol_type = other DNA
ccagcctcttctagcaccctact

SEQ ID NO: 44487 - DNA, 22 bp, synthetic construct
  misc_feature 1..22: note = Synthetic Construct
  source 1..22: mol_type = other DNA
cacagagcagtctacacacaca

SEQ ID NO: 44488 - DNA, 22 bp, synthetic construct
  misc_feature 1..22: note = Synthetic Construct
  source 1..22: mol_type = other DNA
gggtggaggcacatactgtact

SEQ ID NO: 44489 - DNA, 23 bp, synthetic construct
  misc_feature 1..23: note = Synthetic Construct
  source 1..23: mol_type = other DNA
ggcactgcttcctaatccacgat

SEQ ID NO: 44490 - DNA, 24 bp, synthetic construct
  misc_feature 1..24: note = Synthetic Construct
  source 1..24: mol_type = other DNA
ccttgacctttgcaattccctgaa

SEQ ID NO: 44491 - DNA, 20 bp, synthetic construct
  misc_feature 1..20: note = Synthetic Construct
  source 1..20: mol_type = other DNA
tgtcccctcgggtacacaat

SEQ ID NO: 44492 - DNA, 19 bp, synthetic construct
  misc_feature 1..19: note = Synthetic Construct
  source 1..19: mol_type = other DNA
ggctacaggcctggcactt

SEQ ID NO: 44493 - DNA, 25 bp, synthetic construct
  misc_feature 1..25: note = Synthetic Construct
  source 1..25: mol_type = other DNA
ggtttcaagcctcactggtatgtct

SEQ ID NO: 44494 - DNA, 20 bp, synthetic construct
  misc_feature 1..20: note = Synthetic Construct
  source 1..20: mol_type = other DNA
gaaggacagtgcacccaagt

SEQ ID NO: 44495 - DNA, 21 bp, synthetic construct
  misc_feature 1..21: note = Synthetic Construct
  source 1..21: mol_type = other DNA
gggctaaggctccctacacat

SEQ ID NO: 44496 - DNA, 24 bp, synthetic construct
  misc_feature 1..24: note = Synthetic Construct
  source 1..24: mol_type = other DNA
cctgttagctttgctcctgcacaa

SEQ ID NO: 44497 - DNA, 24 bp, synthetic construct
  misc_feature 1..24: note = Synthetic Construct
  source 1..24: mol_type = other DNA
ccttggatcactgaacacctcctt

SEQ ID NO: 44498 - DNA, 25 bp, synthetic construct
  misc_feature 1..25: note = Synthetic Construct
  source 1..25: mol_type = other DNA
gcctgtaagactttaacccagtttg

SEQ ID NO: 44499 - DNA, 25 bp, synthetic construct
  misc_feature 1..25: note = Synthetic Construct
  source 1..25: mol_type = other DNA
gcacctctgtggttattccgtgttc

SEQ ID NO: 44500 - DNA, 20 bp, synthetic construct
  misc_feature 1..20: note = Synthetic Construct
  source 1..20: mol_type = other DNA
ccggataggcagtggcagaa

SEQ ID NO: 44501 - DNA, 30 bp, synthetic construct
  misc_feature 1..30: note = Synthetic Construct
  source 1..30: mol_type = other DNA
ctgcaaactctttcttctcctctaagaaac

SEQ ID NO: 44502 - DNA, 20 bp, synthetic construct
  misc_feature 1..20: note = Synthetic Construct
  source 1..20: mol_type = other DNA
agccgtacgctaggttgtgt

SEQ ID NO: 44503 - DNA, 24 bp, synthetic construct
  misc_feature 1..24: note = Synthetic Construct
  source 1..24: mol_type = other DNA
gtatccagattgcccatagcttgt

SEQ ID NO: 44504 - DNA, 25 bp, synthetic construct
  misc_feature 1..25: note = Synthetic Construct
  source 1..25: mol_type = other DNA
gaggatcaggaaccctaagctttac

SEQ ID NO: 44505 - DNA, 23 bp, synthetic construct
  misc_feature 1..23: note = Synthetic Construct
  source 1..23: mol_type = other DNA
agttacccacactggaaccaaag

SEQ ID NO: 44506 - DNA, 24 bp, synthetic construct
  misc_feature 1..24: note = Synthetic Construct
  source 1..24: mol_type = other DNA
agaatcttgtgggctgagtaacaa

SEQ ID NO: 44507 - DNA, 27 bp, synthetic construct
  misc_feature 1..27: note = Synthetic Construct
  source 1..27: mol_type = other DNA
ccctctgtataggtttccctgtagctt

SEQ ID NO: 44508 - DNA, 28 bp, synthetic construct
  misc_feature 1..28: note = Synthetic Construct
  source 1..28: mol_type = other DNA
gctaggctatgtaagtaggtggagaatg

SEQ ID NO: 44509 - DNA, 27 bp, synthetic construct
  misc_feature 1..27: note = Synthetic Construct
  source 1..27: mol_type = other DNA
gcccctgtattctaaccagtgggattg

SEQ ID NO: 44510 - DNA, 19 bp, synthetic construct
  misc_feature 1..19: note = Synthetic Construct
  source 1..19: mol_type = other DNA
agagcacagggaccacaga

SEQ ID NO: 44511 - DNA, 20 bp, synthetic construct
  misc_feature 1..20: note = Synthetic Construct
  source 1..20: mol_type = other DNA
cagcttccccttctgtgcaa

SEQ ID NO: 44512 - DNA, 22 bp, synthetic construct
  misc_feature 1..22: note = Synthetic Construct
  source 1..22: mol_type = other DNA
aggacctttctggcatgtgttg

SEQ ID NO: 44513 - DNA, 22 bp, synthetic construct
  misc_feature 1..22: note = Synthetic Construct
  source 1..22: mol_type = other DNA
gccacaaccctaccaactgaga

SEQ ID NO: 44514 - DNA, 20 bp, synthetic construct
  misc_feature 1..20: note = Synthetic Construct
  source 1..20: mol_type = other DNA
aaggtttctgcccaggcttt

SEQ ID NO: 44515 - DNA, 27 bp, synthetic construct
  misc_feature 1..27: note = Synthetic Construct
  source 1..27: mol_type = other DNA
gcaaaagtactcgcattgtgaaagcta

SEQ ID NO: 44516 - DNA, 23 bp, synthetic construct
  misc_feature 1..23: note = Synthetic Construct
  source 1..23: mol_type = other DNA
cctctgccccagcatatatcaaa

SEQ ID NO: 44517 - DNA, 22 bp, synthetic construct
  misc_feature 1..22: note = Synthetic Construct
  source 1..22: mol_type = other DNA
cacacccaagaacccactggaa

SEQ ID NO: 44518 - DNA, 22 bp, synthetic construct
  misc_feature 1..22: note = Synthetic Construct
  source 1..22: mol_type = other DNA
gcccagaggcttgacatgatct

SEQ ID NO: 44519 - DNA, 24 bp, synthetic construct
  misc_feature 1..24: note = Synthetic Construct
  source 1..24: mol_type = other DNA
gtcattgcctcaaagggagcttag

SEQ ID NO: 44520 - DNA, 22 bp, synthetic construct
  misc_feature 1..22: note = Synthetic Construct
  source 1..22: mol_type = other DNA
ctagcctctctcagccacattc

SEQ ID NO: 44521 - DNA, 22 bp, synthetic construct
  misc_feature 1..22: note = Synthetic Construct
  source 1..22: mol_type = other DNA
gctcacagtgtgtgtgggcttt

SEQ ID NO: 44522 - DNA, 23 bp, synthetic construct
  misc_feature 1..23: note = Synthetic Construct
  source 1..23: mol_type = other DNA
cctacttttgggaggggaagtga

SEQ ID NO: 44523 - DNA, 23 bp, synthetic construct
  misc_feature 1..23: note = Synthetic Construct
  source 1..23: mol_type = other DNA
gccccttgattcctctaaaccat

SEQ ID NO: 44524 - DNA, 24 bp, synthetic construct
  misc_feature 1..24: note = Synthetic Construct
  source 1..24: mol_type = other DNA
gagccctgaaatcagcttctctct

SEQ ID NO: 44525 - DNA, 26 bp, synthetic construct
  misc_feature 1..26: note = Synthetic Construct
  source 1..26: mol_type = other DNA
ggtggttcagtgtattgtggtagaag

SEQ ID NO: 44526 - DNA, 21 bp, synthetic construct
  misc_feature 1..21: note = Synthetic Construct
  source 1..21: mol_type = other DNA
ggcctgtgcctagcttcaaga

SEQ ID NO: 44527 - DNA, 20 bp, synthetic construct
  misc_feature 1..20: note = Synthetic Construct
  source 1..20: mol_type = other DNA
aacgggcagcaggtggctta

SEQ ID NO: 44528 - DNA, 20 bp, synthetic construct
  misc_feature 1..20: note = Synthetic Construct
  source 1..20: mol_type = other DNA
gaggcaagcctgagtgttct

SEQ ID NO: 44529 - DNA, 22 bp, synthetic construct
  misc_feature 1..22: note = Synthetic Construct
  source 1..22: mol_type = other DNA
tcacccatcagagggctagtgt

SEQ ID NO: 44530 - DNA, 22 bp, synthetic construct
  misc_feature 1..22: note = Synthetic Construct
  source 1..22: mol_type = other DNA
tcccagcttgtctctgggctta

SEQ ID NO: 44531 - DNA, 27 bp, synthetic construct
  misc_feature 1..27: note = Synthetic Construct
  source 1..27: mol_type = other DNA
cagattctgactcacagtggacttgtt

SEQ ID NO: 44532 - DNA, 22 bp, synthetic construct
  misc_feature 1..22: note = Synthetic Construct
  source 1..22: mol_type = other DNA
cctgccaccttgattgctccat

SEQ ID NO: 44533 - DNA, 27 bp, synthetic construct
  misc_feature 1..27: note = Synthetic Construct
  source 1..27: mol_type = other DNA
ccacatacattaccgtctgcttatttg

SEQ ID NO: 44534 - DNA, 23 bp, synthetic construct
  misc_feature 1..23: note = Synthetic Construct
  source 1..23: mol_type = other DNA
cgaacccaagcagtcttctgtct

SEQ ID NO: 44535 - DNA, 23 bp, synthetic construct
  misc_feature 1..23: note = Synthetic Construct
  source 1..23: mol_type = other DNA
gctaggacatccaccagcattca

SEQ ID NO: 44536 - DNA, 22 bp, synthetic construct
  misc_feature 1..22: note = Synthetic Construct
  source 1..22: mol_type = other DNA
ctgtgtttgccatggacacctt

SEQ ID NO: 44537 - DNA, 22 bp, synthetic construct
  misc_feature 1..22: note = Synthetic Construct
  source 1..22: mol_type = other DNA
gccctcaatcacccttgagaca

SEQ ID NO: 44538 - DNA, 23 bp, synthetic construct
  misc_feature 1..23: note = Synthetic Construct
  source 1..23: mol_type = other DNA
gctggctgaatagggacatggaa

SEQ ID NO: 44539 - DNA, 21 bp, synthetic construct
  misc_feature 1..21: note = Synthetic Construct
  source 1..21: mol_type = other DNA
tccttccatgggccagtgtca

SEQ ID NO: 44540 - DNA, 26 bp, synthetic construct
  misc_feature 1..26: note = Synthetic Construct
  source 1..26: mol_type = other DNA
cacaaacttaaggtaaaggggtggaa

SEQ ID NO: 44541 - DNA, 25 bp, synthetic construct
  misc_feature 1..25: note = Synthetic Construct
  source 1..25: mol_type = other DNA
agagtttccttctaacaccccttct

SEQ ID NO: 44542 - DNA, 25 bp, synthetic construct
  misc_feature 1..25: note = Synthetic Construct
  source 1..25: mol_type = other DNA
ggaaatgatccaccatgagtgaaga

SEQ ID NO: 44543 - DNA, 22 bp, synthetic construct
  misc_feature 1..22: note = Synthetic Construct
  source 1..22: mol_type = other DNA
tttggacaggtggaaccaaaga

SEQ ID NO: 44544 - DNA, 21 bp, synthetic construct
  misc_feature 1..21: note = Synthetic Construct
  source 1..21: mol_type = other DNA
ccagaccaaagctgccaccta

SEQ ID NO: 44545 - DNA, 22 bp, synthetic construct
  misc_feature 1..22: note = Synthetic Construct
  source 1..22: mol_type = other DNA
ggagagggaagagtggggacat

SEQ ID NO: 44546 - DNA, 26 bp, synthetic construct
  misc_feature 1..26: note = Synthetic Construct
  source 1..26: mol_type = other DNA
gacgtctaaattgttcttgccacttg

SEQ ID NO: 44547 - DNA, 22 bp, synthetic construct
  misc_feature 1..22: note = Synthetic Construct
  source 1..22: mol_type = other DNA
tccttttccttggtgcctttct

SEQ ID NO: 44548 - DNA, 27 bp, synthetic construct
  misc_feature 1..27: note = Synthetic Construct
  source 1..27: mol_type = other DNA
ctatttcacctggaccatttagactca

SEQ ID NO: 44549 - DNA, 22 bp, synthetic construct
  misc_feature 1..22: note = Synthetic Construct
  source 1..22: mol_type = other DNA
gccccacccgtgtattatgact

SEQ ID NO: 44550 - DNA, 21 bp, synthetic construct
  misc_feature 1..21: note = Synthetic Construct
  source 1..21: mol_type = other DNA
acgaagccttggggaggtaac

SEQ ID NO: 44551 - DNA, 19 bp, synthetic construct
  misc_feature 1..19: note = Synthetic Construct
  source 1..19: mol_type = other DNA
agggctggcaccctaccaa

SEQ ID NO: 44552 - DNA, 20 bp, synthetic construct
  misc_feature 1..20: note = Synthetic Construct
  source 1..20: mol_type = other DNA
tggctatgacgttgctgtgt

SEQ ID NO: 44553 - DNA, 23 bp, synthetic construct
  misc_feature 1..23: note = Synthetic Construct
  source 1..23: mol_type = other DNA
ggctatctgccactggatagcat

SEQ ID NO: 44554 - DNA, 22 bp, synthetic construct
  misc_feature 1..22: note = Synthetic Construct
  source 1..22: mol_type = other DNA
cctgacctaccgcttccataac

SEQ ID NO: 44555 - DNA, 25 bp, synthetic construct
  misc_feature 1..25: note = Synthetic Construct
  source 1..25: mol_type = other DNA
tgacactttgttgtcccctctattc

SEQ ID NO: 44556 - DNA, 21 bp, synthetic construct
  misc_feature 1..21: note = Synthetic Construct
  source 1..21: mol_type = other DNA
ggacaaagctcatgccgaaca

SEQ ID NO: 44557 - DNA, 20 bp, synthetic construct
  misc_feature 1..20: note = Synthetic Construct
  source 1..20: mol_type = other DNA
cagttgcctgaggggaggta

SEQ ID NO: 44558 - DNA, 23 bp, synthetic construct
  misc_feature 1..23: note = Synthetic Construct
  source 1..23: mol_type = other DNA
tttcctcatttcccaggcttgaa

SEQ ID NO: 44559 - DNA, 24 bp, synthetic construct
  misc_feature 1..24: note = Synthetic Construct
  source 1..24: mol_type = other DNA
gggaactttggggcatctaacaac

SEQ ID NO: 44560 - DNA, 22 bp, synthetic construct
  misc_feature 1..22: note = Synthetic Construct
  source 1..22: mol_type = other DNA
acctgagctgagagccatcaca

SEQ ID NO: 44561 - DNA, 22 bp, synthetic construct
  misc_feature 1..22: note = Synthetic Construct
  source 1..22: mol_type = other DNA
tggtaggcagaatccacccatt

SEQ ID NO: 44562 - DNA, 23 bp, synthetic construct
  misc_feature 1..23: note = Synthetic Construct
  source 1..23: mol_type = other DNA
cgacatcctcacgatggcagtag

SEQ ID NO: 44563 - DNA, 28 bp, synthetic construct
  misc_feature 1..28: note = Synthetic Construct
  source 1..28: mol_type = other DNA
ccccagctattaactacttggctacaga

SEQ ID NO: 44564 - DNA, 21 bp, synthetic construct
  misc_feature 1..21: note = Synthetic Construct
  source 1..21: mol_type = other DNA
aggtggagcaactcaaagcaa

SEQ ID NO: 44565 - DNA, 20 bp, synthetic construct
  misc_feature 1..20: note = Synthetic Construct
  source 1..20: mol_type = other DNA
gccaccactgaggaacacat

SEQ ID NO: 44566 - DNA, 23 bp, synthetic construct
  misc_feature 1..23: note = Synthetic Construct
  source 1..23: mol_type = other DNA
ggccaatgtcctcactagacctt

SEQ ID NO: 44567 - DNA, 24 bp, synthetic construct
  misc_feature 1..24: note = Synthetic Construct
  source 1..24: mol_type = other DNA
gtgacaaagccatccttgcttgta

SEQ ID NO: 44568 - DNA, 20 bp, synthetic construct
  misc_feature 1..20: note = Synthetic Construct
  source 1..20: mol_type = other DNA
tctccaccagctgagtcaca

SEQ ID NO: 44569 - DNA, 25 bp, synthetic construct
  misc_feature 1..25: note = Synthetic Construct
  source 1..25: mol_type = other DNA
gaaaagttgtttaaccctgctgaca

SEQ ID NO: 44570 - DNA, 22 bp, synthetic construct
  misc_feature 1..22: note = Synthetic Construct
  source 1..22: mol_type = other DNA
tccaagcctccattgtctctct

SEQ ID NO: 44571 - DNA, 22 bp, synthetic construct
  misc_feature 1..22: note = Synthetic Construct
  source 1..22: mol_type = other DNA
gaactaactcaaggccggagaa

SEQ ID NO: 44572 - DNA, 24 bp, synthetic construct
  misc_feature 1..24: note = Synthetic Construct
  source 1..24: mol_type = other DNA
cctcatatgccaccaattcctttg

SEQ ID NO: 44573 - DNA, 25 bp, synthetic construct
  misc_feature 1..25: note = Synthetic Construct
  source 1..25: mol_type = other DNA
ccacctaatttgctccattccatgt

SEQ ID NO: 44574 - DNA, 27 bp, synthetic construct
  misc_feature 1..27: note = Synthetic Construct
  source 1..27: mol_type = other DNA
gtggagtagacagcaaatgagtaggaa

SEQ ID NO: 44575 - DNA, 21 bp, synthetic construct
  misc_feature 1..21: note = Synthetic Construct
  source 1..21: mol_type = other DNA
gtgcagtaagccccattcagt

SEQ ID NO: 44576 - DNA, 27 bp, synthetic construct
  misc_feature 1..27: note = Synthetic Construct
  source 1..27: mol_type = other DNA
cacctatataatcggcacagagtggtt

SEQ ID NO: 44577 - DNA, 25 bp, synthetic construct
  misc_feature 1..25: note = Synthetic Construct
  source 1..25: mol_type = other DNA
catgtttccaaacacatgcatcaga

SEQ ID NO: 44578 - DNA, 21 bp, synthetic construct
  misc_feature 1..21: note = Synthetic Construct
  source 1..21: mol_type = other DNA
gggagtggcatggaagaatca

SEQ ID NO: 44579 - DNA, 23 bp, synthetic construct
  misc_feature 1..23: note = Synthetic Construct
  source 1..23: mol_type = other DNA
caggcttcccaaccttctcatag

SEQ ID NO: 44580 - DNA, 20 bp, synthetic construct
  misc_feature 1..20: note = Synthetic Construct
  source 1..20: mol_type = other DNA
acccgtggcatctgctctta

SEQ ID NO: 44581 - DNA, 24 bp, synthetic construct
  misc_feature 1..24: note = Synthetic Construct
  source 1..24: mol_type = other DNA
cagcaaagagacgtttgtggaatg

SEQ ID NO: 44582 - DNA, 26 bp, synthetic construct
  misc_feature 1..26: note = Synthetic Construct
  source 1..26: mol_type = other DNA
gcccttatctcaatgatccccacctt

SEQ ID NO: 44583 - DNA, 24 bp, synthetic construct
  misc_feature 1..24: note = Synthetic Construct
  source 1..24: mol_type = other DNA
accccagtgttgctctatacattg

SEQ ID NO: 44584 - DNA, 22 bp, synthetic construct
  misc_feature 1..22: note = Synthetic Construct
  source 1..22: mol_type = other DNA
ctgggtaccgagtatgggatca

SEQ ID NO: 44585 - DNA, 24 bp, synthetic construct
  misc_feature 1..24: note = Synthetic Construct
  source 1..24: mol_type = other DNA
ccagaaaaggcaaaccctacattc

SEQ ID NO: 44586 - DNA, 22 bp, synthetic construct
  misc_feature 1..22: note = Synthetic Construct
  source 1..22: mol_type = other DNA
agcagtgaggccagaaacttag

SEQ ID NO: 44587 - DNA, 23 bp, synthetic construct
  misc_feature 1..23: note = Synthetic Construct
  source 1..23: mol_type = other DNA
tggattccaaactttgcgtgcta

SEQ ID NO: 44588 - DNA, 22 bp, synthetic construct
  misc_feature 1..22: note = Synthetic Construct
  source 1..22: mol_type = other DNA
tggtctgtgggttgggaagact

SEQ ID NO: 44589 - DNA, 20 bp, synthetic construct
  misc_feature 1..20: note = Synthetic Construct
  source 1..20: mol_type = other DNA
ggcttccaagtggtggcaat

SEQ ID NO: 44590 - DNA, 19 bp, synthetic construct
  misc_feature 1..19: note = Synthetic Construct
  source 1..19: mol_type = other DNA
aggcaggggtggtcactca

SEQ ID NO: 44591 - DNA, 18 bp, synthetic construct
  misc_feature 1..18: note = Synthetic Construct
  source 1..18: mol_type = other DNA
tcgccactgccacacact

SEQ ID NO: 44592 - DNA, 24 bp, synthetic construct
  misc_feature 1..24: note = Synthetic Construct
  source 1..24: mol_type = other DNA
agtagaagatcagcttcccactct

SEQ ID NO: 44593 - DNA, 24 bp, synthetic construct
  misc_feature 1..24: note = Synthetic Construct
  source 1..24: mol_type = other DNA
gcctatagtgaacaccaccgtaga

SEQ ID NO: 44594 - DNA, 25 bp, synthetic construct
  misc_feature 1..25: note = Synthetic Construct
  source 1..25: mol_type = other DNA
ccatgtccattgctaggtgctattg

SEQ ID NO: 44595 - DNA, 22 bp, synthetic construct
  misc_feature 1..22: note = Synthetic Construct
  source 1..22: mol_type = other DNA
cgacggaacagaacctctcctt

SEQ ID NO: 44596 - DNA, 21 bp, synthetic construct
  misc_feature 1..21: note = Synthetic Construct
  source 1..21: mol_type = other DNA
gctcactgcagcttgctctct

SEQ ID NO: 44597 - DNA, 30 bp, synthetic construct
  misc_feature 1..30: note = Synthetic Construct
  source 1..30: mol_type = other DNA
gccaatagctaatgctacaagtagctcaaa

SEQ ID NO: 44598 - DNA, 24 bp, synthetic construct
  misc_feature 1..24: note = Synthetic Construct
  source 1..24: mol_type = other DNA
ttctccatagacgtgaccatcaac

SEQ ID NO: 44599 - DNA, 21 bp, synthetic construct
  misc_feature 1..21: note = Synthetic Construct
  source 1..21: mol_type = other DNA
gcagctggagtttccgtcaca

SEQ ID NO: 44600 - DNA, 23 bp, synthetic construct
  misc_feature 1..23: note = Synthetic Construct
  source 1..23: mol_type = other DNA
cctcagccaagggagggagttat

SEQ ID NO: 44601 - DNA, 26 bp, synthetic construct
  misc_feature 1..26: note = Synthetic Construct
  source 1..26: mol_type = other DNA
gcaaaatcttagagaagctgggttga

SEQ ID NO: 44602 - DNA, 29 bp, synthetic construct
  misc_feature 1..29: note = Synthetic Construct
  source 1..29: mol_type = other DNA
ggtgtccatgtactagaaggagagttatc

SEQ ID NO: 44603 - DNA, 23 bp, synthetic construct
  misc_feature 1..23: note = Synthetic Construct
  source 1..23: mol_type = other DNA
gctgtttttgaagctggcaaagt

SEQ ID NO: 44604 - DNA, 20 bp, synthetic construct
  misc_feature 1..20: note = Synthetic Construct
  source 1..20: mol_type = other DNA
tgctcacgtgtgtcctggaa

SEQ ID NO: 44605 - DNA, 24 bp, synthetic construct
  misc_feature 1..24: note = Synthetic Construct
  source 1..24: mol_type = other DNA
gccccatctgagagacagcaattc

SEQ ID NO: 44606 - DNA, 21 bp, synthetic construct
  misc_feature 1..21: note = Synthetic Construct
  source 1..21: mol_type = other DNA
tagggcggcagggttggacta

SEQ ID NO: 44607 - DNA, 22 bp, synthetic construct
  misc_feature 1..22: note = Synthetic Construct
  source 1..22: mol_type = other DNA
ccagggtggtttctccctgaaa

SEQ ID NO: 44608 - DNA, 20 bp, synthetic construct
  misc_feature 1..20: note = Synthetic Construct
  source 1..20: mol_type = other DNA
atcacctctccctgcacctt

SEQ ID NO: 44609 - DNA, 24 bp, synthetic construct
  misc_feature 1..24: note = Synthetic Construct
  source 1..24: mol_type = other DNA
caactaagatggaccccaggattg

SEQ ID NO: 44610 - DNA, 20 bp, synthetic construct
  misc_feature 1..20: note = Synthetic Construct
  source 1..20: mol_type = other DNA
cctgtgcctgccttccgaat

SEQ ID NO: 44611 - DNA, 42 bp, synthetic construct
  misc_feature 1..42: note = Synthetic Construct
  source 1..42: mol_type = other DNA
aactcacatagcacacgacgctcttccgatcttgcaagcaca

SEQ ID NO: 44612 - DNA, 39 bp, synthetic construct
  misc_feature 1..39: note = Synthetic Construct
  source 1..39: mol_type = other DNA
tcctctgtgacacgacgctcttccgatctccctgctctt

SEQ ID NO: 44613 - DNA, 40 bp, synthetic construct
  misc_feature 1..40: note = Synthetic Construct
  source 1..40: mol_type = other DNA
tcctctctctacacgacgctcttccgatctcgggctgtca

SEQ ID NO: 44614 - DNA, 42 bp, synthetic construct
  misc_feature 1..42: note = Synthetic Construct
  source 1..42: mol_type = other DNA
tacatccttgagacacgacgctcttccgatctgctgtgcagt

SEQ ID NO: 44615 - DNA, 42 bp, synthetic construct
  misc_feature 1..42: note = Synthetic Construct
  source 1..42: mol_type = other DNA
tttgcttgagctacacgacgctcttccgatctcgggagtttc

SEQ ID NO: 44616 - DNA, 42 bp, synthetic construct
  misc_feature 1..42: note = Synthetic Construct
  source 1..42: mol_type = other DNA
gtcttatggtggacacgacgctcttccgatctcaaagccagt

SEQ ID NO: 44617 - DNA, 50 bp, synthetic construct
  misc_feature 1..50: note = Synthetic Construct
  source 1..50: mol_type = other DNA
aactcacatagctgatcggtacacgacgctcttccgatcttgcaagcaca

SEQ ID NO: 44618 - DNA, 47 bp, synthetic construct
  misc_feature 1..47: note = Synthetic Construct
  source 1..47: mol_type = other DNA
tcctctgtgtgatcggtacacgacgctcttccgatctccctgctctt

SEQ ID NO: 44619 - DNA, 48 bp, synthetic construct
  misc_feature 1..48: note = Synthetic Construct
  source 1..48: mol_type = other DNA
tcctctctcttgatcggtacacgacgctcttccgatctcgggctgtca

SEQ ID NO: 44620 - DNA, 50 bp, synthetic construct
  misc_feature 1..50: note = Synthetic Construct
  source 1..50: mol_type = other DNA
tacatccttgagtgatcggtacacgacgctcttccgatctgctgtgcagt

SEQ ID NO: 44621 - DNA, 50 bp, synthetic construct
  misc_feature 1..50: note = Synthetic Construct
  source 1..50: mol_type = other DNA
tttgcttgagcttgatcggtacacgacgctcttccgatctcgggagtttc

SEQ ID NO: 44622 - DNA, 50 bp, synthetic construct
  misc_feature 1..50: note = Synthetic Construct
  source 1..50: mol_type = other DNA
gtcttatggtggtgatcggtacacgacgctcttccgatctcaaagccagt

SEQ ID NO: 44623 - skipped

SEQ ID NO: 44624 - DNA, 16 bp, synthetic construct
  misc_feature 1..16: note = Synthetic Construct
  source 1..16: mol_type = other DNA
cgtgacgtgacggact
